United States Patent 12,576,115 (BACTERIAL COMPOSITIONS FOR TREATING AND PREVENTING HALITOSIS) - sequence listing, part 3

SEQ ID NO: 19 - DNA, 3538924 bp, unidentified (residues 1,769,463-3,538,924 of 3,538,924)
  source 1..3538924: mol_type = genomic DNA; note = Lactiplantibacillus plantarum 1
ttatgcactaattaggaaacatgcgcagcttgatttatcacgccagccctttgagcaagaatatgcggcgacctgcgttcctaatcaacgaattgcggattatttgcacgtgagtctggatacgatggtgattaagatcgaacggtgggtatttcaaggggaagaaacgctggaatataccgttagttacatgttgcctaactattttgggctggcgctaactagtgattccaagtcggtagatcctaaccgaattcgatgatcgatgcataaagagaggagtggcacacaatgtcaattcatagcaataacttttattccaacgtgttacgacagtcagtgcaagtccaagttatcttgccggaaccagtgaacgcggtcggacaaattttaccagactacagtagtggtgaacagcaacttccaactgtgtggctgttgcatggcttaggtggggacgcaacgtcgtggttacggcgaacggaaatcgaactactggcaacgcaataccgagtagcggtcgtcatgccggaaacggggcggggattttatacgaatatggtccatggtccacgctattgggattacttgacccacgagttaccaacacgaatgcgttatatcttcccgttgtcggcacgaccggaagacaattatttgttggggaactccatgggtggctatggggcattacgttatgcctttacctatccgcagcggtttgcggctgtcgcggcactatcaccggtgacggatctcaaaaggtttcacgtggaacaatcggcaattatgccagaccttgagctggctttctcaccagcacagatgcaagggacgccagcggatttgtcttacttggtacagcaaccgacaaactgggggacgttacgtgttctaatggcgacgggtgatcaagatatgttacggtcaatggatgaagccttcaagccagagttggcggctgtatttaaagaccagtttgaatggcagttacaaccgggtcaccatgattggcggctctggaatcatcagttaccatttgcgatgcactggttaattaagggaggttggcgcaatgtttaatgttaaagatgagcacggccactataatttgtggcggcagacgggattagcgttattaccgctattattggcaattatcgcatatccactgctacctaatcgtgtctacgtgccaaccgctgtcaccagtctgacgccgtggggaatcaagagcaatatcttcatttatcccgtcttttgcctgattctgtggttctttatctggctatttatcttcttcaaccggctatatgaaaaaaatctcaaggtaacccgccaaaaatatcggccaatggaaaactactatgtgtggagcagctgggtgttggatattctggcgactttgatggtggtggttcagatcttggtaagtgttagtcggtgagtggtcgaaaaaattgaaatatattaagtaaactacaattgataagcgcttacatctggagtaaaatattatgttaatagatgagcaaaacactttgttactcaattcaaattttacaagggcaaaggttaactcatatgacatcaacagaacgtattaaaacaacgatatgtttgtatcttaattaccttgttcatggtatggctattgtgattctcgcccaaaatatgactgtgttaagtcaacaatggcatgtcaatgatgctggtgtttcacttgttatttcatcattaggtattggacgattactagtgctttatttagccgggaccttctcagatcgacttggtcgaaaattatttgttcagattggtatcttaacatatacactgttttttattggcattgtcatttctcctaacattgccgttgcctatttcttcggtattctagccggaatggctaattcatttttagattcgggaacatatccagcactcatggaactttatcctcaaaggcaagcaacggcgaatatcatgattaaagcgtttgcttcgattggtgaattattattacctattatcgtggctggactagatcattttcaactatggtatggttgggcatttttattgtgtgtgtgtttaatggtagttaactttagctttttacgtcagcgaacttttccaagactaacaactaatcgagtaacaatgcctaataaaaagcagaacactctgcaaaagcatataccactaacgccaaagaaaattatccttggatgtgttctgacggtttttggatatatctcaatggcaactttttatttagtgagccaatggttgacaaagtatggcagtgacgtgattcatttgaatttagtacacgctcgcatgttagtcagcgtctatagcgttggttctattttaggcgtgattgtaactgctttactagttgagcggattattaagccggtttggtttatgctgtttgatacggtggtatcgttgttagcactggtagctttaacgctaatcccaacgtggtgggtagctttaatcagttcgtttgtgattggatgctcagctgcaggcggtgttatgcaattaggattaaccgttatgagtaatacgtttccccgcgctaagggccgtattacaggaatttattatactgcgagtggattagcttcatttacgattccggtatttaccgcttggatttcacagattggtatttatgaaattatgtggtttgacgtattaattgctggaattggtgttctttgcagtattgtagttcttaccctatcgcgagaaaagaagacaattgttgcttagtaaaaaatctctcaggtctataacacgcattatcactagtctggcgataatgcatgttgcaaacccgagagttttttgtcctaaattaaacgttcctgttgtgtgtaatgttgccaacagtaactgcgactgaattcttcaaatcgactaactgaaggtgtaacaaaatgattacgtttgctgatgaggtatatttggtgacgtagtggctgatcggctaagtgcttcaacgttatgctggtctggtctaaaagcggtaagtatggcatcaaagcaacgccaaaattatagctcacaaagccagccatggtatggtcctcctcgacttcgtaaacgatttttggtttcacatgcgcctgccttagaattcgatcaatcaaaggacgtaaaccactattatgtgagaaaaatatcatgggatatggttccaagtctttaacgaataattcttcttgtttggctaacgcgtggtggctagggacagccgccacaatttcttgttgaaccaatggaataaaatcaaacaaggtattagtgggttgctcgccaaggcgttcgacacttgaggctaacactaaatcaaacttttcatcagcaagttcttggagtaattcagttgagtttccttgaccgagttcaaatgtaattgcatgatttttatcatctgtatggaacttagtgattagttcggggactagctgctgtccaagtgtataagtaaaccccaatttaacatgtcctttgtcaggatccattaattgctgaacgagttcattgccttgtgataaatcgcttaaacttgccgtaatatattttaaatacacggaaccaatcggtgttaaacgaatattacgaccatctggttcaaataaagggacccccaattcactttctaactttttaatggcatagctcaatgaaggttgtgagataccaaggttttcagccgcttttgccatatgttgtgtccgtgctaattctttaaaaaattctaagtgtcttagattcaatctacatgatacccctttcattcataaaagaatttaatcgatttagcaactgttctatatttattatattaaagcattttgttaagatgacaagtgaattgagtaacaaatattaaaaatataaatttataggagtggattaacatgactgaacgcattgatggacacacattattaattggattgatggcatatccgattcggcattcaatgtcaccaacgatgcacaataatgcatttgctaaattaggactgaactatgcatatctagcattcgaaatcgataacaaaaagctaccttcagcaattgaatcgattcggacgttagatatgcggggttctaatgtttcaatgcctaataagcagaaggttttgccactgctagacaaattagacccagctgctgagatgtgtggtgcggtcaacactattgttaatgatgatggaattttaaccggttacacgactgatggtattggttttatgaagtctctggacgatgaaggaattaatattcgtggtcataagatgacgttagcaggtgccggtggtgctgggactgcaattgctgttcaagcagctttggacggagttagtgaaatgtcaatctttaacttacatgatgcagagtgggaaaatgctaaacataacgttgatttgatcaacgagcggacttcctgccatgctactttacacgaattagaagatcgtgatgattttaagaaggaaattcaagattcttatatttatactgatgctactggtgttggtatgaagccattagaagataagactttagttgatgatccaagttggttacgtaaggatctgattgtattcgacaccgtatacgcaccacggacaactaagttaatgaaggttgcccaagaagctggcgttgaacatgtcttcaatggtttgggtatgatgctcgaacaaggtgctgctgcttttaagctctggactggtgaagatatgccggttgattatattcgccatattttatttgatgaagacgctgcagcacaaaaatagacgggggttgccatgaaaaataaatatatgccgacagccattagcttatatttaaactattttattcatgggattggggttattattttagcccaaaacatggaagctttggctcaacactggcagacgactacaggtggtgttgccgtggtaatttcatcacttggaattggtcgtttgattgttttgttagtttctggatttctatcagataagtttggccgtaaaccattcgtggttcttggtgttgttacgtacttgctcttctttgctggtattctattaagcccttcaattacggtggcttatgtttttgggatacttgctgggatagcgaactcattccttgattctgggacttatccggcattaatggaaatgtttccagattcaaaaggaactgcgaacgttattatcaaggccttcatttctgttggtcaatttggattgccgttattcgttagtttcttagttgctggtaattattggtacggttggtcgtttatcttctgtattgttgtattagttgttaacttactattcatgttggctgctgggaagttcccagttgctaatcaggatgctaaagttgctgcgaaagaagaaggtaagacagttcaatctgaatcaaagggtagcttatggtttgatggaacgctatttatcttatatggttatgtatctcaggcaaccttctacttagttagtcaatggttgagtcagtatggtgcaaaggttgccggcatgggcgatgcaagttcacgagcactgatcagttattatagtgttgggtcaatcgtttgtgtactggtgacggctgcgctagctaaacgtgctgtaaaagaaattcaattcttaggaatctataccttactttcatttctctcgttactactgatgtatctggtaccaacatctttgatgtgttcaatcatgtcatttgttgttggattctcagctgctggtggggttatgcaattaggattgacagtcatgtccaccttcttcccacaaggaaaggggacgattaccggtgctttttatacagcggggtcgattgcgtcctttacgataccgttagttacaggtatgatgtcaactaatcttgcaaacattttcttgtttgacgttattattgcgttgattggatttgtattggctgtactcattacagttcgctattaccacttgtttggcaagaacagtcaaaaggaggtcacgattgatcatgacaccaatcgttaaattacgtgatattgaattaggaacgggacggcctaagattgccgttccaattacgggaaaaactattgcggatattttagctgcagttgaaccaataaaggctgcacagccagatgtcgttgaatggcgaattgattttttcaaggatgtaactaatccagaacagttgaaatcggccggtcagcaacttcgtcaggctttaggtgatattgccttattaactactttccgaactaaaggtgaaggcggcgaattagcactatcagatactgagtattttaaactgtgtgatacggtcttagatggtgggttcacggatgccttagatgttgagcgttaccatgacgaacaagctgttaaacaaattgttgcagcagctcatgagcatcaagtagttgtgatcatgagtaatcatgattttgataaaacgccggcggttgctgagatcgttaagcgcctgactagtatggtcgattatggtgctgacgttgctaagatggctgtgatgccacaatcggtggaggatgtcttaacattactgacagcgactaatattgcacgccaaacactaccacagccagtaatcacaatgtcgatgggtgacttaggaaaagtgtcacggcttgctggtgaagtgttcggctcttgtttatcatttgcaacggtcggggcggcttcggcacctgggcaaattgcacttgaaaatttacggccggaattggaagatctgaagttaaattaaggcataactgaaagaaatcgtgaggtcagagtgatgattgggacacaaaaaaagtatgtttcacaatttacgatgatgggaaccgtcatctcgctgacattatttgagccgaatcagttagcagtcgaagcggtctatgattacttgcagcggatggatggtgtcttttctgtcaatcgtgccgattcagaattagctgcgatcaatcaatatgccggtattcatccagttttggttagcactgaatgctttcaactagtgtcggatgctattaagtacacaaagcaatatgcggatagttttaatgtgctaattggaccgttggttaaactttggaagattggttttggtgggcatcaagtaccagcggccaaggaaattagacaacgattagccttattagatacgcacgaagttatcctagatgaagcccaatcgagtatctacttgcgtcaatctggcatgcaattagatcttggtgcgattgccaaggggtattttgccgatcaggtcgttaagcagttgcagcaggctggtattaccaacgctattgttaatcttggtggtaacgttaagctattaggggccaatccgctaaccgataatcggcgttggcaagttggaattcaagcacccgaagcgccacgtggctatccagcgctacaggtcgaaatgcctgccagaacggtagtaacgtcaggtatcttcgaacgatattttaaaattggcaatcaccgctaccaccatatccttgatccgcgaactggttatccggttgaaaatcaagttgatcaggtgtcgattataactgaacggtcagaattagctgaagtgttatcaacggtggcctactttgaagggccaaaccgtggttgtcaactaatcgaacagttgccacatacggaagcaatttttattgatcatgaacaacaggtaacagttaccagtggcttaacgccgcgacgcaaaggagtgtttactattgagtaaaaaacaaattaccggccaagcaatgggccacaacggtattatcaattatgaagttgacgtgcaagataataagattgaggatttgaaaatattaaagcattccgaaacgtcggggatctttaaccaagtcattgataaattgaaacaaaatatcattacggaacaatcattcaatgttgacacaattagtggtgcaacggtgatgacccaagcgttacttaagtcggcagataaggctgtaaccgatgctggtgttgatgtgcagccagttcctaagaaaaaagcccccaagacgcaaaacttgcggaccgacgtgctcattattggtggcggagaagcgggcttagtcgctggctgtcgagcgttgacaatgggtcagaaggttatcttagttgaaaagaacggctatcttggtggtgcgacgattctgaatggttctaacgttgttggtaccgggtctgatgttgctgcgcaaatttttgataataatcatgatacgccagaaatgttggcacaagatgttgctcgtgaaagcttggagacgaactatccagctttgaccgacctaatggtgcataacattggtccagccattgattttattagtaagtttgcagatttacattatcaaaaagcacagacgcaaacgccagaacattcgattaaccgtcagattgaactaccttcagcaagtagctatgaattcattcaaaaagtttcgaaggcgtttgctgctgcgggtggtcagattatgttggatactcgagtcgagaagcttatgttggacaacgataaaaagttacgcggtgtgattgctgctcaaaaggaccaaacagtcaacatcaaggcacgttcagttgtgcttgctgcaggtggtcatggcgctaaccaaaagatgcgtggtaccgaaagtgaaggcattgattattatggcccaatgacttccactggggatgcctatcaatttaatggtgatttggatttgcaaacgcacgatttaggttggtacaagctgtatccacatggcgttgaagtggaaccaggcgttgctaaattgaccacgtacgcgtcgaaacaagcaactgatatgggtgcaatttacgttaactctaagggtgatcgaatcgttaacgaatcaaatgtttatacgacttttcggaatgccatccttaaacaagcggataaagttgcttacctagtaatggatgaacggacttggaagaaagtttacgacctactgatcctgcatgatttcacaccagaagaaattaagagcttctttgagaataagggtaaacggccagtatttgttaagggttctttggaaagtgctgctgagcaggccggaattgtggttgatgaattagtccaaacggtcaaaaattatcaaggctatgttcaagatggtcacgatcatgatttcggtcgtgatccgaagtacttgcaccaatttgaaggtgaaacattctacatcattgaacaacgtgatcgctttgcgacgactttaggtggctatagtgttgatgctgataacttgcaattggtaacgactaaaaatgcaccggtagctaattactttggtgcgggggaaatcatcggcggcgctaacggacatgattcaatgccaagtatgatgaatacttgggggatttcgtcgggttacgttgccggcgccgcggctagcgaaaacgctcagcggcaggcaaccgcgggcgatgacgaagccaatattgtggccattgtggggactaacgcttcaaaatcatataaccgtaagttgttgtatgccatgaaagaattatttgaaacgcaagttaattttgaaatttgtgaaattaaagatttaccgctattcaatgaagatgatatggatcgggaaccggcaagtgtaaaagcgttagccgctaagattgaagccgctgatggtgtcgtctttggcgtgccagaatatgatcattcgattccagctgccttgaagagtgccattgaatggctgtcctgtgcagaacatccattcaaagacaaaccagtgatgattgttgggacttcgttaggtattcaaggtacggtacgtgctcagatgaacttacgacagattttggactcacccggtgtggatgccaaagttatgcctggtaacgagttcatgttacctcaagccggcaataagtttgatgagaacgatcatctgaatgatgacggtagtgaacacttcttgaagcagtgctttgggcactttttagaggggcttgaattagcatctaagaagacagtgacgaattaactactatctagactaaaagaacgtacacaactcgtgtacgttcttttagtctagattttagttgttaaatcttttgttccacatcgtcgattgtgacaaccagggtcgcgcgaatccaatcaaacttagtatgcatttgatcgaaataagcgccactagtttcaaacttgccggtaccatgaatgtggaaaccacagccagtaccagttgtgccgggaaccttgtaactaccgacagcaattgtaatgtggttgtcggtagcaaaatcggcctcaattgagtgcatgccagccgatgggatcaatagggtatgatcatcgataagttgcatataatgactccaggtgttgacgacgtgtgctggtgcggcgttgaccgtaacgatggttgcgggggtcgtgtctttgataacttcaataaatttagggtccataataagtactcctttacgtttatattctcataatatattgtagttgatatatataaattatcaagcgagagtgttcgatgtctcaataatcttagcggaggtagcatggtaaaaccaggcgttgctttttactaatgaaagcggtaactttagctaggaacgaataacgagagggtgtttaatatgtatcaagcaagccagaagcgctatgaccatatgatttataatcgagtaggcaatagtggtttgaagctgtcagcaatcgggctaggtctttggaataattttggaagcgttgatccgatcgctaatcaaaaggcaatcattcatcaagcttttgatttgggaattacctactacgacttagccaataactatggcccggagcccggcagtgcagaaacgaattttggtcgtattatggctaccgatatgcggtcataccgtgacgaaatggtcattgctagtaaagcgggctatgtgatgtggccgggaccatacggcaattgggggtcacgaaaaagtattattgccagtgctgatcagagtcttcagcgaactggtttagactactttgatattttttatagtcaccgtcctgatcctgaaacaccaatggaggagacggccgctgcgcttgatcagctagtacggcagggtaagacattgtatgtaggcatttcaaattataatggcaagcagacggctgctatgaccaagatatttgaatcattaggaaccccatacattattcaccaaccacgctataatatgtttaatcgacaggtggaacaggacttgttccccgttctacaagcaactcataaggcggcggttggctttagctcactatcacaggggttattgacggacaagtatctgcacggaatcacgacagattcacgggccaataagcaaacaattccatttttgagtccagtccaggtagaacagacactagctacggtaaagcgcttaaatgaagtcgcgcaacaacgggagcaaagcttagctcaaatggctttggcttggaacctacgtcagccagccttagcaagtgtcttgattggtgctagccggccagagcaggtggttaataacgttgctgcattggaaaagttgaaatttagtgaatcagaattagcaacgattgaacagattcttaccgaacaaccggcaattgattggaatgctggtcgatcatagcgtttgcacaattcgctatagtcaatgttatagagccgcaaaagaaagggccatatccgaggatatggccctttctgtacctaatagttaagttaataataacatagttttgcagatttgcacgcacaggggggcctttactaaataaattagtgtttaaattcgcgaattttcacaattaatgataaagttttacatgatagttatcacgattatgcgttgaagttcggcgcaatacttgaaaattaaaataatttgcaaataaatcatgcgatagcgactttagatggtagtaagaattagtttgaatttaagggggccaattcatggcggcgacgctaaaagatattgcaaataaagttggcgtatcattggcaacggtatcgcgcgtgttaaacaaagatcagtcattgtctgttagtgatacaacgcgccaacgaattctagatgcagcagaagcattacagtattcaaaaaataaacggcatactgtcacgacggcgcgtaagcgacttgctattgttcaatggtattcggaatctaaggaacaagatgatttgtattatatgtcggtccggatggggattgaacgtcgtggacaggataatcagtttgaagtgactcggattttccaaaataatttacaagaattgggaccagacgtagatgcagtgattgcagttggaaagttcagcgagccacaagtcaaggacttggcatcagtaactgacaacttagtattcgtagatgatgatcagtttgatgctggttttgatagtgtcattactgattttcggttggccacagaaaaagttgtcgattatttttggcaacgcaactttcatcatattggctttattcacggtcaagaaatgacaaccgaccatcagttagcggtagttgatcgacgcatgctaggttttcgggccgcgatggaacgacggcatgcgtttgatcctaagttcgtttttaagggcgattatactagtgaatctgggtttaaaatgatgcaaaaagccattcgtaagttgggagaccagctaccaggagccttctttgtggcaaatgatccgatggcggcaggtgcgcttaaagcgttgcaagctagtggcatccaggtgccagaacgagtgaagctatttagctttaacaatacttcgctggcgacattcgtttatcccgaattaagcgcagttaacgtagatactgagttaatgggggcgaccgcagttaatttggtcatcagtcgactagcagggcgaacaacgacacaacgggttgagctgggtactaatctggttgagcgagcaagttccaagtagtgaagggcgatctgggatagaaaccagatcgttcttttggtgttttaactaaaagttttactcaacttcaagaaattctggtatacttctaaatgaaagcggtttaaataacacggaggtgcatgattttggaaactaaaaaaacggtgtttgaccaactagatggtcaagatgtaatgcgttatacgctggtcaatgaccatcaaactcgtatctcggtccttagttatggtgggacgtggcaagaattcgtcgtcaatgaagacggcgttgagcatcccttgatttggggccttgataacatgactgactatcaacgagtgggatactgcctatgtcaatcaattggtcgggttgctggccggattggcggcgctaagttcaaaatcgatgatcaatcctatcaagttgatatgaacgaacaaacccattcgctacacggcgggaatcatggctttaacacgctgaactttgaaggtgcttttagccaaaccaatgatagtgtcagtgtgactttgaagaagcatatcaacgccagtgatgataattacccgggaaatatggatgtcgctatcaagtttacattagataatcaggatcaagtatccattgcatttaccggtgatactgatgcagcaaccctctttaatccaactaatcacgtttattggaacacaactgatgatcggaccagtttggcccaacaaaaattacagattacgagtgcagctcacttggaatttgatgatgaaaaagtcccaactggtaaggaattagcagttaaaggcacagcgtatgactttaaccaggcacaaccagttgaaaaggcattagcccagctgaagactgagaatggtggcattgaatttgacgatgcgtatgaagtcgccccaagtgcggcagaaccaattgctatcgttggggatactgatgataagcgccaagtaaaaatttattcagatcgcaatagtcttattatattcacggctaatccgtttgatgctgataaggaagacgcgcatcaatataatgcgttagcgacggaagcccagacacttcctgatgcaatcaatcatcctgattttggtgatattgtgttacgtccaggagcaccagtgacgcatacgattcggtaccaatatgaacggttaaattaatactagttgaggtgtcaggcgagttctgcctggcgccttttttgtaaacgtatgagtaaacaatgtttaatttagttaacaaagtcccgagcatctgattaataccgtgattagtaaaacgatgatcattggtaagataatgagtactatactgcttaagcccttggaaagcgggcaatcagtgtcgataggcgcattagcaggtcctaatcaaaagcggtatagataaaacttttgaacaaattttactaaaaatcattgacattacttctgaaaacgattacatttaaacttgtaaattattcaaggaagatgtgaggcgagattatggatgcagagacaaagcagagtaaaggtcgtaaaataacatcgcgacttgcttattcgtttggggcgtttgggcacgatgccttctatgccactttatcaacttattttattatgtttgtgacctcccacttgttcgataagagtagtggggctcaaggaacacaaatgattgcttggatcaccatgattattgcaggtttgcggttcgtggaactagcaattgatcctttgatcgggaatgccattgataatactaattctcggtggggccactttaaaccatggattgtcattggtgggattataggttccgtcgttttagcacttttattcacgagtttaggcggattaaatacctcaaaccccattctatatttaattatttttgcaattttatacattacaatggatattttctattcgtttaaagacgttggtttttggtcaatgattccagcaatctcatttgactcagcagaacgtgaaaagacggcgacatacgcccgggttggctctaacattggtgccaacatcgttggggttatcgttatgccaatcgtcttaatgttttctgttaagtctaacagtggtcaaggtgacaaccgtggttggatggcatttgggatcattattgccgcaatcgctttgatttctgccttagttgttgcacttggaaccaaagaaaatgattctgaattgcgtaagaacactgaaaagactagcttcaaggaagtcttcaaagtgttagcccgtaacgatcaattgatgtggttatcattgatgtatgggatctacacggcagggattgccattacgaactcactagaactttactacttcacctatattttgggtgacgcctcgaagtttacactattaggttcgctaaatgcgattattgggatttttgccgtattggccttcccaccattagcaaagaagtttagtcgtcgtaaagtgttcttcttagcagttgttattatgatgatttcactgatcatgtttgcctttgctggtcagtcattaccaatgatcttaacagcggccgtattattctacattccacaaccattaattttcttagttgttttgatggttttgagtgattctgttgaatatgggcaattgaagtttggccatcgtgacgaatctttaaccttatccgttcggcctttacttgataaattaggcggtgcgatttctaacggtgtcgttggtttaactgctgtttgggctgggatgacagctggtgccactgctggtgatgtgactagccatggcgctgccatcttcaagttaatgatgttcggtgtacctgctgctatgattttgattgggacattcatcttcttcaagaaggttaagttggatgaaaagatgcatgcacaaatcgttgatgaacttgaaaaaacatggtcaacacacttggaaaccgatgaaactcctgctgaagttgaagcagaagccgatgccaagacgacggtttatcaagatcctgttgccggggaactgatcagtttgaaagatgttgctgacgaatccttcgcaaacggtagtatgggtaaaggttttgccattaaaccaacggatggtcgcgttgtcgcaccatttgatggtgaagttgttgcaaccttcccgactcgccatgcgatcggattacgttctgataccggtattttaacgctaattcatattgggattggtactgttaagatgcgcgggactggatttgttcagtacgttgagaagggcgaccatgtcacacaagggcaagaattaattgaattctggcaaccagcaattgaaaaggctggcttggatgataccgttatggtcgttattacaaactataaagatatgcccgaatttacgtatcttaaagattcaggaaccaccgtacaagatgatgaagatgtcttacaattatcgaatgtcggcttaccggatcaagcatagtttctttacgaggagagctattaatgacgcgagccattaatagctctttttgtgaactgaaatagaaaaagctaatagcgaagggaagattttactatggcagtaacgttgcagcaaactttaattgacattgatgaagaacaacttgtctttcacctgcataacgatcaaatatcgtatattctaggtgtggagacaggcaacgtgttggcccacttgtactttggcccacgggttcgaggttatcatggcgagcgtcagtatccccggattgatcgggggttctcaggaaatttaccgaatacgactgatcgaagctattccaaggatgatttgccacaggaatacggtggcaataataccggtgattatcggcaacccgccgcgattattcgcgcggccaatggtgctcgaacagttgattttcgttatcaggactgccggatggaagccggtaagccggaacttaagggcttgccacaaacttatgtcgaagatgaggatgaagcccaaactttgattgtgacgttgcgagatgccacattaggcgtgacactcgaattagcctacacgatttatcgggatcggccagttatcacgcgtagcgcccggttgattaatcacagtgagcaagctgtcgacttagaaaaagtggcttcgatgcagatggacctgccaacccaaccattagatgccatttcgttacctggaagctatgcgcgtgagcgccagcttagtcgtgaacggctccatcgaggtgtaactcagtttgaaagtcgccggggtgctagttctcatcatatgaatccttttgtggcgctagctgatccgaatactaatgaatttcaaggcaatgtccttggtgcattgctaatttattcaggtaaccaccagattagtttagaacgggacccaattggtcagacgcgcttgactatgggaatcaatgaatataacttcgactggcgattggcggccggtgatagtttccaaacgcccgaggttgcaatggtatactcgacgacggggcttaatggtatgtcgcaaacctaccatgatttattgcgtgatcgcgtggcgcgcagtcgttacaagcacgatctccggccgatcttgatcaacaattgggaagccacttactttgactttgatgcggacaagattcaatcaatcttggatgctgcagcaccactgggtatcgaaatgtttgtgctggatgacggttggttcggtcatcgaaatgatgataatagttcgctaggtgactggtttgttaatcggaacaagttaccaggaggcttagcggatattagcaaacggacccatgataaagggatgcggttcggactttggttcgagccagaaaatatttcagccgattccgatctttatcgggcccatcctgattgggtgttaggcgtaccagatcgtggccgaacgttatcgcggaacgaatacgtgcttgatttcagccagccggatgttgtcgacaatatttttgaacaaatgaccgcagttcttgataaggtgcccattgattatatcaagtgggatatgaaccgcaatttaacggaagtctattcgccacatagcgattcaactcatgaaggtgagactagccaccgctttatcttaggtgtatatgacttgatggagcgtttaacgaaacgctatccacagatcttatttgaaggctgctctggcggtggtggccgctttgatgctggtttaatgtattatatgccacagagttggccatcagataataatgacccgattgaacggctcaaaattcaatatgggacttcactcgtttatccaatttctgcaattaccgcccatgttgggacgagcccggatgaattgttaggacggtcgacgtcgatgaagatgcgtggtgctgtggcaatgagtggtaccttgggctatgaactggacgcggcccaactaagtgatgcggacaagcaggccgttaaaagacaggttgccttctataagcagcaccgtgagttagttcaatacgggaccttttatcgattagagagcccgtttgaatctaatacggtggcgtggatgtttgttagtccggatcagaaagaagccttgctgttcaccttcgttattttaggtgcagttcaaccagaaccgcatattacgaagttagcgggattagaccctcagcagacctatgttgagaccgacacaaacaaaatgtacggtggcgatgaattgatgcaactaggactctacacgactcccgttcaaactagtgactttacggcgcaggtgcattacttcaaggctaaggactaagctcagccattaaacatattaaaacttaatcatcgttaatctaaaagaacgctctggcaaataacctgccggagcgttcttttgaaatcaaattaatttttagaaatgaatgttaaagctgaagtcaatgtcttgatcagcgggaatatgatatggggcttctacgtccgtaccccaactatcaatgccaccgaccccacgaacggcaccgtagattgataagaccgttcgccgtgctaatggtaattcttccatgtgcgttgcgttttctagttcagcggcggtatagggaagacagctgaaggcgaatggtgcatcggcttggctaaatgtcaaactgaacggtgtgttgtcgtggtcagcgttattttgtgttgttgatcgcgttactgtcacttgttcagtttgcatgtgcatgccgcattcttgtgggaccaagtatggtgtgactggcagactgtcaacgtggaatcgcccgtgcgttgcgccagccagccggtcaggataagtctcaccagacaaaccggtatagtcgaagccggtcgcagtagttggcatgataaaccgcagaccaaatgcgggtagctctggcaaatcagactgaccgctataatgggtggcgatattgatctgaccgtctgctgtcaccgtataagtcactgtgacgatggtactaggaacggtcgtggtaacgaagtggtaagccagtgagactttcgtggcgatttcgtgatccgtgtatttgttattgagtggcgcgattggtaacggtgtgactggttggtcgtcaaccgtcaattcgatatcttgacaagttgagaacttatcggccgcgtaccactgtgcggatttgactgaaaagccgctaccgtgatcattatcggttgtcgcccgccaaaagatgggcgtgggtgtacgatagagccactctttatcgttgacgacgagtgattcaagtccgccacgttcgtagctaaagaggtagtggaaattagccccctgtagtcctaaactcccgtcgccgtaaataacgtgtagttgattatttgtgtaagccataataatatttcacctcttgcattgctggttttggtgtccggtcggcaaacattaagccgtcaccggagaattcataatcggagtggcgttcgtcgaaatcaccgccataccggagcacgtcttggtcggtaattgggtcatgaacgaagagggcttgatcaataaagtcccaaataaagccaccttgatacatcggatacttgtcgatcaaatcattatatgattgcataccgcccagagaattccccatgtcatgcatatattcacaatctaggaaaggtttggttgggttatcttccaagtaagctacaatattttggggcttttcgtacatccgactttcaacatcagaaatgcgatcttttaattctggtgtgtggacaacaccttcgtagtggacgagtcgtgaatcatcgtgttctttataaaaagcctgcatcgccgcgatatcttcgccagcatacgattcattgccaagtgaccaaaaaatgatcgatgggtggtttttaaaccattcgtagttcgaacgggcccggtcgatcaccgctgctaaccagtgtggattatcgccaggaacattgtaagaaggctcgatagcacccatcttttgccatgacccgtgcgattcgaggttgttttcggccattaggtagataccggcctcgtcacataattgataccaaggtaattgatcaggataatggcaggtccgatcggcattgatattgttagctaacatggtttggatatcagcgcgcatatcatccatactgataacgcgaccggtgtgggcgttccattcgtgccggttaaccccgttgatcaccaaccgtttattgttgacgtaaatgactttgtcatcgcgcagctcgaccgtccggaacccaaactgatatgggacgacttccaagagttggtgatcagcatcgtaaacttcaattgtcaattgatagagatacggcgtttgtggtgaccacaagtgcagttggtcgaataacatggtatcaaaggttacactgccactaccggtttgcgtttgactcgtcagtactcgcccgtcatggtctttaacggtcagcgccaaagtggctggttcgccggttactttagtagtgatgttgagctcaccacttttgagattggcatttggaactggtcggatgtccaaatcagtaatatggctagcaggctccgccagtatattgacgtcacggaaaataccagagaaacggaacatatcttggtcttcaataaaggcagcagtactgcgtttgtagacccgaaccgctaaaacgttaccttggtcctgaatatacggcgtcaaatcaaattctgaaggggtgaaactatcttcagcgtagccaataaaatggccatttaaccagacgtacagggcttcttctaccccttggaactgaatgataatacgttgccctttaaaagcatcgtcgagatcaaaggttttgaggtacgagccgacggtgttgtccgcagcgtcgctgaataggcctggtgttaattgatcttgattgagggtatacggtgggcgacgataaattttaccttcccatgggtatagcgtgttaatgtattgaatttgaccatagccggctagttcaatatgaccgggaacttgaatcgtatcaaagtcggttgcatcgaaatcgggttgataaaaatcaactgggcgttcagccggtgtcttggcgaagttaaaacgccaagcgccattgagactcttgatgaagcgactacccgttttgaattctgctgtgtcgtgataataatggtgatcactatgtgcaggtaattggttgacccggaagacttctgggtcatctaaccattgaagattagcttgcatgaggaagctcctttcaaagttacataaataaaaacgcttacaattatcataaaacaaaatattaaatttgtatatgtcgttttagttaaactttaactaaatgacaacaactactgacaacgacaacgggcgataagaagaatttgaatcgataacgtgataaatttgtaaagcgttaccaaatcttgttctaaaggtcttatggggtgttgacaacaatcaaaaaaagcattatagtcaaactaataaaattttagtaaaactatttacggagggatttttcatgaatactagcgacttaaaacaggagtttaccgaagcctttgataccaagccagaacgggtctttttctcacctggtcgaatcaacttgatcggtgaacatactgattataacgggggccatgttttcccatgtgcgattacaatcgggacatatggtgtttatgcaccccggacagatacgacagtgcggatgtactcagctaatattccagatgctgggatcgtcacgtttgatgtcaacgacctttcatatgacaaagccgctggttggacaaattatcctaagggaatgatggacgaaatcgcgaagaccggcgttaaattcgatcatggttttgatttctacgtccatggcaacatgcctgatggtgctggattatcatcatctgcgtcaattgagttattaactggaatcatgttaaacactggttttaatctcggtattagccaattagatcttgttaagattggtcaaaagtgcgaaaacaactatgttggtgttaactccgggatcatggatcaatttgctgttggaatgggtaaaaaggaccaagcaattttacttgataccaacaccatggactattcttatgcacccgtaaagttaggcaacaacgtaatcgttatcatgaatacgaacaaacggcgcgaattggcggattcaaaatataatgaacgccgctccgaatgtgaagaagcattacgccgattacaaactaagttagacatcaaatcacttggcgatttaactaacgaccagtttgacgaagcggcctacttaatcaatgatgaaaccttaatcaaacgtgcccggcatgccgttttcgaaaatcaacgggccattcgcgcaactaaggccttggctgacgatgatttaacgacctttggcgaattagtgacggcttcccacgtttcactacactttgactatgaagtgactgggaaagaattggatacgttggccgaaacagcttggaaacaaccaggcgtgcttggtgcgcggatgactggtgctggctttggtggctgtggtattgccatcgttgataaggaccaagtcgatgcctttaaggaaaacgtcggtaaagtttatcgcgacacgattggttacgacgctgatttctacattgctgaaatcgcagacggccctaaggaactttaataaaagaattgatttaaaatacaaattagcagtaagcattgagaaatattgaggaggaattagaatggcagttttagttttaggtggtgccggctacatcggttcacacgcagttgatcggttggttgcaaaggggtatgacgtggcggttgttgataacttggtcacggggcaccgggcagcggtcaatgaacacgcgcgtttttatgaaggtgatgtccgggatacggcgttcatgaataccgtgtttgaccaagaaaacgttgaaggtgtcattcattttgcagctttctcagttgttcctgaatcgatgaaagatccgctcaagtactttgataacaacacggcagggatggttaagttgctcgaagtgatggctaagcacgatgtgaagaaaatcgtcttctcatcgaccgcagcaacttatggtgaacctaagcaggtgccaatcaaggaatcggacccacaagtgccaactaacccatacggtgaaagtaaattagcgatggaaaagatcatgcactggtcagatgtggcttacgggattaaattcgtggccttacgttactttaacgtggcgggggctaagcctgacggcagcatcggcgaagatcacgcaccagaaacgcatctcgtcccaattattttacaagtagctgctggtgaacgggatcaattacaaatcttcggtgacgactatccaactccagacgggaccaatgttcgggactatgttcacgttgtcgatttagctgatgcacatatcttagccttggaatacctaaagcaggggcacgatagcgatgcgtttaacttgggttcttcaacgggcttctccaacaaacaaatgttggacgctgctcgtgaagtcactggtaagccaattccagcagtcatggcaccacgccgcgctggtgatccaagcacattggttgcagctagcgacaaggcacgtactgttttaggttggacacctcagtatgatgatgtgaaagaaattatcaagacggcttggacttggaaagaaagtcatccggccggctatgatgatcggggaggccaagcataatgacgagtttggatcaatttgtcacggcggtgatcgcgtcgccttcgcaatatactgaattagatcgaatctatgtgcataaccgggttcttggtttggtcggcgagggtgatccgattgcggcaagcgatgaccaattaacaagtttaaccgatgccttggttaaaacggcgattcaaaatggcaagatcgaagcgacccaatcggatgaagatatcttagcggatcaattgatggatcttgtgaccccgttaccatccgtattaaaccaacgtttttgggataagtatcaggttagtccgcaaacggcaaccgactatttctttaacttaagcaaagctaatgattatatcaagacgcgggccattgcgaaaaacgtggtctttccagcaaaaacgccatttggtgacttagagattaccatcaacttatcaaagcctgaaaaggatcctaaagcgattgcggcagcgcgtaaccaaccgcaagatggctatccactttgccaactatgtatgcagaatgaaggctatctaggccggctcggttacccagcacggagcaatcaccgaattattcggttaacacttggtggcaatacttggggtttccaatattctccatatgcttactttaatgaacactcgattttcttggatcaagagcaccggccaatggtcattaaccggcaaacttttaccaacttacttgaaattgttcagcaatttccacattactttgtgggcagtaatgcggacttgccaattgttggtggttcaatgctgtcacacgagcattaccaaggtggtcggcacgaatttccaatgatgaaagcgccaattgcacgcacgattgacttaggtatcgcgggtgttaaggctgggattgttaaatggccaatgtcgacgattcggctgacgagtcaggacttggttgcattaacggatgccgctgtgaagattcatgagacgtggaagaattattcggacgagagtgtggatgttcgtgcttatacggatggcacacgtcatcacacaacgacaccgattgcacgcaaagttggcgatgactacgtattagatatcgttttgcgtgataatcagacgtctgctgaatttccagatggcatcttccatccacatcaggatgttcaacatatcaagaaggaaaatattggcttgattgaagtgatgggccgggccattttaccagcccggttgaagaccgaattagctgaagtcggcaaatacttgttggatcagcctaatcaaatggtcgcgatgcatcaagcatgggctgatcaattgaaggccactaataccatcaccgctgacaatgtgacgactgtcattgatacggcggtcggcaacgtctttgcccgggttctggccgatgctggggtctttaagtgggatgacgctggtgaggcagcctttgatcgttttgtcgcagcaatgcacgattaagttgttaatcaaatgaagacgtggggcaacggggtgttgcagacgcgatttaccgactagtcatgattggtgaatagtgtcacgcccagttgccccacgtttgttattcagtgctaattaagagaaaagaggaatgacgatggccgtaacgttaaaagatattgcgcaacgagcagatgtctcattggcgacggtatcgcgggtcttaaattatgacaagacactatcagtgagcgagcagacacgcaagcgcgtgtttacgattgctggcgagctgcggtacagtaagcgtaaacgtcagcatataaaggcgctaatgcggaaaaatatcgctgtgattcagtggtactctaagattcaagaacatgatgacttatattatttagcgattcgtaaaggaattgagcatcaagctcaagtgtgtggttttacgacgactagtatcttccagaataatttagatcaggttggcgatgatattgatgcaatcgtggcggtgggaaaatttagccctgtccaagtacaacagttgagtcgtttgtcaagccagcttgtttttgttgatgacgatcactttgctcagggattcagcagtgtggtgactgattttacgtttgctactaaccgcgtcgttgattatttttggcggcgtggtatccgagatatcggcatgatttatggcaaagagtggtccactgatcagcaggtggagattcccaatcaacgtcagcaaagctttgaacaggcgttgcagcggcatcatgcctatcatgctgagtatgtattagctggtgattacactagtcaatctggttatctgatgatgaaacgggccattgaaatgttaggtgaccgcttaccacacgctttctttatcgctaatgatccgatggcagccggtgcgctcaaagcgttacagcaagctgatattgctgtgccacagcgggtcaagttgtttagtttcaataacacgacgctggccgaatatgtgtatccagagattagctcggtcaatgttgagactgaactgatgggaaagacggccatcgatttgttggtgagccgattccaagatgatcgtcaagcagcccagcgcattgaactgggaacgacgttggtagaacgtgaaagcaccaaatgaaatcatcgagtgttcgtgaaatttggcagaaatatcgtaattaattaatgtgccacccgattgttaaaaagtggtgcatgactttgatggggtactggttggtattgaatagcgcgcgtgaatgggttgagtggtcatgctactgctttctgattagttggtctgttttgctaaggtgtgaggccataataacgacaattgtacccttcaagggtataattgtgagtgaggtgatgaaaatgaaaacaactgccacaatccttaaggagattcggcaacattaccaaattagtcaggcaaagctggcaaagttactcaacacctcggttagaacggtgcagcactgggaacaagcggactaccaaccaagtggcaccgcggtacgtttgattcagattttggctacggacgatgcggtgtataccgcactgacaaacctcgaggaggagaatacgattatgtatttagaacacgatgatcagaagttcaccatcatgggtgtgcagtttcggaatcaagaggaataccgggcgaccatgaatgcaattatcagcaatatgtatgagggttttgagccgactaaggaagatgttcaagacgctcgtcgtttctatgacgaaggcccgattagcgcacaagagatgctagcaagaatacgtacttcgaccaatcgtaaagccgaatgagaaaggtatgggcggactacctacaaccaaacggtattttgaaaaatcgcttaggcattactgaagcggctactttgcagaaaattgagtacaaagtgagtacgcaacggcaacagcaattatcccgcaatcactatcttctgccagactctcatcaattgacaggacgtcaaattggagagctaaaattgatcaatgggtttttgctcggtgaaatttacgactgggccggtcactatcgcgaagttgatttcaacaagactgcgaatggcgtggtgacgtttttccacccggtggctttatttggtaatgctgagatggatattcaacgccaactcgataattttgcgatgttaccgaatgatcgggaacagcttgcacaggcgttgggacaagttgtcaccgaaatcaacatgtttcatccgtttcgggaaggtaatggccgcacgacgcggctgtttactgaggttttggcttggcagcatggttttgacatcaactatacccaggcacagcaggatgcttacatgcaagcgtcaattcaagatgatgctgagatgatggcacaggtgttcctggaagtactaaccaaatagatcaattattgttagtcgtgatactaagaatggtcttaaattaaaacaacaagtgcactcggaaatttctaatctgagtgcacttgttgttttagtttagtgagatatatgacgtttgtcgcagcggtcaattttactgcttgagtgggccactaacttttcgtttatattcggatggggtggtctttaggtattttttaaacagacgaaagagtgatgaggtgttttgatatccgatgatgtcgcaaatgtcagcgagtgtacagttagttttgatcatcagattttgggcagcagaaattcggcggcggtcaacaagttctttaaaggtcttgcccgtcgcttcttttaatttgttacccagataattcgtattataagagaacttggcgctgacatcacgtaatgtcacgctggcgaaattctgattgatgtactgaatgattggcaaaagattgtcgtccgtattgtcagaaaagttaatgtattcttgctcaatcgattgcgataattcaagaattaatgtagatagcaacaggcccattgatttattacgttggcggctctttgtaaggcccttgataattaaactttcaactaaattgatggcaacttcttggtgtgttaagtcaaacagaataaagttgttgtgcaacgtattgatgtgggatgcattatataaaaattgagtgatttcattggttgaaacggcaatatagtcgaaaagttggttcatcgttgagtcattcttgagcaagatgttaatcaaaatatcattactgcccgttgattcaatttgctgaacaatgtctttatccatcaaaattaggttgtgctgatggagggtcactttttcgccattaatatactgagtacaagtgccagcatacatataattaagctcaataaagctatgcgtgtgagctggaacataggaaaagcgattatttttggtaacagcaatatcaccgtgcttaaaaaaatctgagcggggcatctggggaatcggattattcacatagtctaagtccatgtagttaacgttaccatgtgattggcgttgctttagctcaaccggtgtcagagcaaataattcgtaattgagaaatttactagtcattaatactaaccttctttaatatttatcgtttagtacaacctgtgattttgcacgatcattcatgtagttgagatatggtaccccttacagtaatcgcttacaatattcgtataaataaagggaggttcttcatatgaataacggcgagacgtcaacttcaatggtgaaaaaatatcggccattagcagtagctgcaggaattggttccattctaggatcaggaattatcgttggcttatccgcgactattacagtgtggcagaacggactaggtcttactaacagtcaagttggtattatttcaggtgcactaacttttgcaattgcaattggatccttattagcaggacagataacaaaatcttttggtctagttaaatcgtttaattggttaaacctgatttatgcgattggcgccttgatctgtgttttctcgaataattatatcatgcttttgattggcgtcatcattaccgggttagcttcgggtgctgatttaccaattagtttaaccgtagtttcgcatgatgcaccggatgataagacctcggctagtttagtatcgtcgacgcaaatcttctggcaaattggggttttcatgtcttatgtttgtgcctttattgtttctaaaatggccggtgcttccggtgctcggattgttttttcgattttagcaatttttgccttgattacttgggcatggcggactttttcaactaagttccgagcatttcatgaagaaggtgaacaacggcgtattgatcgcgaagcagcttcacagacaacagagaaggtctcgattaagacggtcttcgctggtgccaacaagggacgctttatggcattcttcttcagtattttaatcttctatgtttgctggaatctactggccaatacgttcggacagtttcaaacgtttacgctggttcaagcacatgcgagtcaaagtttcgcaactggtgctgggatagtcctaaactttatctcgttgttggcaaccatggcttttgcatcagtcgctgggggtaagtatcgtaataagttcttcttagttgggattaccgttcaatttttggcaatgctcggactagcaatgagtagtcattcgttatggccaattgtcatcacgattggctgttacaacattgggaataatattgctggtgaagcgatgtataaagtttggacacaggaagcatttccagttgaagttcgggcatcagttcaaggatttattaatggcttttcacgggtatgttgtggcctatttgccttaattacacctgcgttagttgtgccatcagcaattcgtaacacgatgtttgggttcgctgccattgtctttattagctttgtagcagggctgacaatgatgcgattggaaaagaaacatggtattaataacttttaaacaaagtatttagaaagcgagtggaagagatggcgtttacttttcaaatcaataatgatgttcaatttcggcataatcaagcattattagacaagtcggcaagctatcggccaatactgaaagaaacccaagttaaggcggcatcgattgtggcgctcgagcgtgatacgcaataccttgaaggatggggtgttaaacaaattgcacctattgaacgattatcaagttatgagttgaaacgtgacgaccaaattatcatagattttggcgatcatcaggttggtcaatttagtattaatattaacgctgttggttcaccaatggatgcaccactatgttttaagattaagtttgctgaaatgcctgcagaattagcacgcaagagtgaagattacgacggttggttgagcaaatcttggattcaagaagaaactgttcacttagatgtgctgccaaccacgctgacgttaccacgacgctatagttttcgttatgctgagatcacagttgttgatacgtcaccaaaatggcgagctgtttttagcaatccagtggtcacggcgacaagtgcggtagacactgcgacagtgcatcaaccgaaattagccgatgcacaattacaacggatttatgaggttggcttgaaaacattagctgattgtatgcaggatgtctttgaagatggaccaaagcgcgatcggcgattatggattggtgatcttcggctacaagcattggccaattatgcaacgttcaaagatacagatctggtcaagcggtgtctgtatttgttcggtgcgatgcctacaacggctggccggattcctgccaatgtttttactaaaccaacggcagttccagatgacaccttcttgtttgattacagtctattctttatttcaattttggctgattatgaggcgtttagttctgataaaacagttttgaatgatttatatcgtgttgctaaaaagcaaatggatttggcgttggcacaagttacttctgaaggtaaattgaaattgactgaagaaaatccggttttcatcgactggtcaaatgattttgacaaagaaacggctgggcaggccattattatttatacgctaaaacaatttattacgcttgcggaactggttaatgatacaagcttagagacctatacagcgatactgcgtaaattaaaccagtacgctaaaactcaattgtttgattcgcaatcggggttatttgtctcaggggatcagcgtgaagttaatgtggcaagccaagtgtggatgacactagcacatgttttggatcctgagcaaaccacggcgcttatgcaaacgaccgtcacgaaactgtttccaattactggtattgcaacgccgtatatgtatcaccatattacggaagcattatttgaagcaggattaaagcaagaggccgtccaattaatgaaagattactggggcaaaatgattacgctaggtgcggatacttattgggaagcatttgatcctaatcaacctgattattcgccgtatgggagtcccattttaaatagttattgtcatgcttggagctgtacaccggtgtacttgattaataagtacctcgtttaggaggagtgtctgcgatggttgacgaaaaagtaaagctgagtaaagcaaacgtactcttaataattgttgctggtctagcttcctatatggatgcagcgttgctcgttagtctgggagtagcgctacctatctggacaaaatatttagcactgaatagctggatggtcggactactaagtactatgctgacggtcgcggttgcgattggttcatttgtgggcggctggctgtcggataaatttggccgggtcgcggtgtttaatgctgatatcttttttgtcgcgattggttcgtttgttattgcgattgcacaaaatacgacgatattgattattggtgttgtgattgctggtttggcctctggtgctgatttaccaacgtcattggcggttatttcggaacggatgtctagtaaagtttatggtcgggcaatttcttcaactcagattttttggacgatgggcattttgttgtcacagtttattggttttataactgctaacagtggtatgggaagcccggcagccttatttggttggattggattagtggcaattattaattggtgcgtgcgggtcttttcaaagcgttttaaacagattgaaacagacttagttgaccatgaacatgtggactgtgcatctaacggtcaatcggttaagaagtatcgattaggtcagctattgcgaacaggtggtttgttagtaccaatgattctactaactgttttttatctattttggaatttgccggccaatacgtgggggtcatttgttaactatttcttagtgactgttgatggccgtacgcaagcctattcgacaatcgtggcattaattgccaatatcgtgtgtctgttagttaacctgatctatttaaaggtttcagacactaggtatcgctaccgagtgatgtatttaggtattgccgtagcattgctttcctttgtgactgcagagatctttagtgatgactggcagattttcaccgttgtttatattttctactctggtagcacagtattatgtggtgaggccctttataaaatttggagtcagactttctatccagtggatgcacgggcaacgatgacgggcttttcttatggcttagttcgggtgctgaccgctgctttctcactagtaacgccaacattaatgggatattcgccgcaactcttattatggattatggttggatgtacggtgctatttggtgcctgtgcagtgatcattgtcgctattattaagaagaccggtttaaaagacccaacgatgaaagcggtttctgaataaactgattaatattactaagaattaaaaatgtaagccgggcattgccgggcttatttatttaaaatcaaggaggataatgctcatgtcgaaagaggctgtttggttatggtatcctggtgattttgaaatccaccaagggatgttacaaaattttaaacgtgaagaacgtgggatgggttggcctgcctattggtatattgatgattgcaaccgtaatgttaattttaaacggcactatgatttaaaagaatccacacaatttacagtactcgccaaaggaacgggctatgttgatgttaatggcactaagtatcgcttaaatcatgcgattaattgtgatgcgggtgcgactgatattcaagtgtttgttggtaacgttcagggattgccgacgatttatattgttggtgagattatcaaatctgatagtggttggctagctagcaattttgtcaccacattacccgctggtcacgatattctctacactgaccgtaaccaggatcctaatgtgattgaatatcggacagaaaaagtagtggccaaagcacaacaagcagttgacggtggcgttttatatgattttggtcgcgctgtgaatggaactgtcacagtcaaaacgaatgggccagttacgctatgttacggggagtccgaaactgaagcacgggatgttgagatgtgttattacaagcagtcggacgttacagctacaacaaaggttcgtaaacgtgcgtttcgatatgtctttgtgcctcattgtcagttaggtgacattgaattaactgctatgcacgaatatattcctaaaaataatccctccagttttacctctgataataagttgatcaatcaaatttggaatgtagcgacggaaacgttaaacctttgcagtgacttgttctttatcgatgggatcaaacgtgatcggtggatttgggctggtgacgcgtaccaagctaattttatcaatcaatattctttcttcaacgaagatattgataaacggacgttattagcgttgcgtgggcaagatgatattaagcaacatatgaatacaattgtcgactattccatgttgtgggtgattggtgttctaaatcattaccagatgacgggtgaccgtgaatttctcaaaattatttaccctaagttagagagtatggtgcaatactttattcaacagacaaatgagcatggttttatttatggtcggaaaaatgactggatctttgtcgattggtcagaaatggataaacagggtaccgtggcggctgaacaaatcttattacttgaagattacaagacaattatgacttgtggtgaggtcttaggcaaagatgtggcgggctaccaagcgaagtatgaccagttgtttaagaacttaatgaaatacttttgggatgatgaacaaggagcatttattgatagttatgaatcgggtaagcggcacgttactcgtcatgctaatatttttgccattttgtttgacgttgttgatgagaacaaacaacaattaattttaaagaatgttttgttgaataatgcgattactcaaattaccacgccgtattttaagttttttgaacaagatgctttatgtaagctgggggaacaacaccgtgtttaccaagttttattagactattggggcggcatgttagatcgcggggccgtgaccttctgggaagaattcgatccgtcgcagcatggcaaggatatgtatgccatgtatggtgatccctatggtaagagcctgtgccatgcctggggagccagtccgatatatttattaggtcgtcattttgtaggattacggcccacggctccaggataccagacttttgagatcaagcctgagttatcagaatttcatcatttacacaccgtgttacccattaaaggcggtaccgtgactgtcgtaaaagatcaacaccaactatcagtcactgctagccgagctggtgggacattgattgtggatgggcaaagacaatctttggaacctaatagaactgcggtggtcccagtgtagccgtcattattttaatgggttaatttagaagacacttttggtatgcgcttgttgaagcaagtgcataccaaaagtgtctttgatttgtgtcaaactatgatttattcgtcggcttcacaaaacttttccgataaattaatttagcatcaactaataccatgcgcttctgtgaacggtcaaaaataatcgtatctttcaatgttgtgatagcctgtgcggctaagtcgtctgtgtcaatgtggaaagtcgtcaatggtggtgaaacgtagcgcgcaatgtcgatatcgttaatactaataattgcggtatcagtagggactgtgattttgttttcattgaaagcctgtaagacacccacggccaacggatctgaaccgactaagaaccctttgggcaatgcttgtttactcaacgattgcacgacttgttgtcccaagcgatagccacttgcaacggagaattcaccaccaatgaatagaaaccgcgaatcaaatagttgtaactcgcgtagccgactttcaaagtatttttggcgcggatcttgttgatgggtgacttgttgatctttattccagtagccgccgttaatgagaccaatgggcgtatcacctgcggctatcaattgatcgatggcttgttcggtaattgcttggaggttaggctgtacagaattgaagtgatgcgggtctggattggaatcaacgaagattctgtggggtgttagctggcgcaatttatggagcgcatcagaatcgaattcgccaactgccatcacaccgtcgatgtcgtggggaatgtggtcgatatccggataaaaggtgagctttaaattagcctgttttccgtgttcaacgagactctgacgcaaattactgaaataaatatcttcaagttcttgttttggttggacagcgaagattgtagctatctgataggcaaggccgtgagtggtgtttggttgttcgtaattcaagttttgagcagtttgtagtatttttttgcgagcgtgatccgagattgaaaatgacggatcattattcaacagccgtgagacggttgccggtgaatagcccgctttagctgcaatttcacgaatagtcggcacagtggaagactcctttcgacaaacaagttgctaaacagatgattaccagagttaaaaagcttcacttataataatacgctttcattagcgctaataaaagcagtaatgaatataaacaaaacgtaaatagtgtttactgatatttagtaattattttagtaaaacgggttacattcgtaaatgaaagcgcttatcataagagctgttaaagcgtaattaagttgatagaagtgagggtgcgtttgaatgtccaatccattaaagacaacagaatttttgcatggtggtgattataatccagaccagtggcttgaccaacccgaggtgattaagcaggattttaaagcgtttaaggctgctaagttaaatacggtgacattgggaatctttgcttgggacaagttagagcctgctgaggggcagtatgattttagctggttagatcaaattttcgatcgtgccgaagcccaagggactaagatcattttgtcgacgccaagcggggctcgtccacgctggttagctgagaaatatccagaagtgttacgtgtcaatgaacacggacagcgaaatcaattcggcgagcgacataatcactgttacacatcgccagtttaccgagaaaaggttcaaatgattaaccagaagttggcggaacgttacggtcaacgaccaagcttgctgctatggcatatctctaatgaatatggcggtgcttgttactgtgatttgtgccagcaagcctttcgtcattgggttcaaaaaaagtatcaaacgttagccaatttgaaccatgcttactgtggtgctttttggagtcacgattatacaagttgggatcaggttcaggcaccgtcgccgctgggtgatacgaatgtaatgggacttaacctggattggcatcgttttgtaacagaccggacgattgacttttttgataatgaaattaaaccgttacgagcgctgacacctaatatccctgtgacagccaattttatgggtggcaacccatcagaatcacacgtcttttatgatttagattatcagaagtttgcgaagcatgtcgatattgtgagttgggattcatatcctaattggagtaatggttacgaaagtacggcccacttggccatgaaaactgctttgatgaatgacgtgatgcggagcctcaagcatgataactacttgattatggaaagtacaccgtcacaggttaattggcacccatataatcgtgccaaacgaccaggcatgcacgaaatggggagcttgcaacaggttgcccatggtgccgactcagttttgtatttccaactacatcaatcattaggagcttctgaaatgtttcatggcgccgtcattgccaaccattgtggctcaaatacgcgggcatttaaggacgttcaaaaagttggtcaggacttacaaagcttacaggccgcgcatggaacgaccagaactgcagctaaagtcgctattgtctttgattatgacaacatgtggggcttagatgatgcccgcaactacgctaacgaaactaaaaagtattggcgcacgattcaagaacattaccagtatttctggaaacatgatattccagttgaaattattgcgactactgatgatttgacagcctatgatttggtgattgatccgatgcacttcatggtgagcgcccagtttgcgactaagcttaaagcatatgtgcaacagggcggccatctgatcggcacctatattacgggcgtcgttgatcatgacttcttagcctatcaaggtgatgggttagctgacttagaagcaacttacggaattaaagttcaggaaactgacacattatatccgcaacaacataatgcactgactgcttatcaccaagcgtatcaagtgaatgattattgtgatgtagttgagacgacaacggcacaagtcctcggcacgtatcaaaaagacttttatgctggaacaccggctgtaacggtcaatcaattgggccagggagcggcgtattatttggctgcgcggaccgatactgacttcttggatgctttctatgaacggcttgccacaagtttggcacttaaaccggccttgccagtgatcaaagcgaatgccaaggtaagtattcaagttagagagaatgcgacgacgcgctattacttcgtgatcaattttagtcatcgaccaacgacggtgacacttgaagtgccgttacggcagatttttgagaatcaagtggtcagtggcaagcaagacttggccagctatggtgttcaagtctatatgatgaataaataattaagtggggtgaaattaatggcacaaaatgttgaacaacaaccagtaaccaagaaaaagttatcatggcatcaaattaatgaaggtgttgcctttggattaggtaacttaggacactcggcattctatggtgcgttgagtacctattttattgtttttgtcactagtgggatgtttagcggcgttgcaccagctatcgccaatcggttgattggtttaatcacaggactggtggtggtgattcgtttagcggaagtcgttgtcgatccaatcttaggcaatattgttgataatacggaaacacgttggggtaagtttaagccttggcaagtcattgggagtattatcagttcggtcttattagtcgttattttctcaggaatctttggattagcaaaggtaaactggattttatttgcaattgtttttgtgattttatttattatcttggatgtcttctattcgttaacagatgtctcgtattggggcatggttccagcgattagtgaagatagtcatgcccggggaattttcacggctcttggcagttttactgggacgatcggttggaacggcctgacaatggtcgttgtaccaattaccacgtactttacctttatcgcaactggtaagcatacccaaggtccacaaggctggctagcgtttgccgttattgtcggtattgtggcagtcatttccgcactatttgtcgcctttggaaccagtgagaagcacaatgcgattcgggaagcagccaaacaaaagacgacgatcaaaggtgtctttatgggcattatcaagaatgaccaaattatgtgggtcagtctgggttacttattctattcattagcatacgtgacaaccaacggggttctattctatctttttaaattcgtgattggtaaacctggtgaattttggattgctggggcggtcgccactgtgatcggttttgtgacgtcaccactatatccaatcttgaaccggtttattccacggaaagtgctctttgcactcggtcaatgctcaatgattttagcctatattatctttattgttgcgcagacgaatttgaccttattgatcatcggattagtccttttcaatattaactttgcccaattagtcacggtcctatcaatgaccgatgccattgaatacggtcaattgaagaatggcaatcgtaatgaagcggtggtgcttgccgttcggccgatgctcgacaaaattactggtgccttttccaacggtatcgtcggtgccattgctttagttgctggtatgactggtagtgcaacggccgccgatatgactgcaagtaatattcatacgtttgaactcttagcgttttacttgccgttagcatgtgcaatcttgtcattgttagtctttacattcaaagtaaccattaccgaaaagaaacatgccgaaattgttgaagagttacaggctaaattggcaacaggggaagcagcggatgttgcggtaacgcctgcatctgacattctgaccactgaaatcttagcaccagtaagcggtcaaccgctcgcattagcggatgtcaaaagtgccgcacagccacaaggcttaccgggagttggtttcgccatcaggccaagtgatggtcgcctctatgcgccattcgatgggacgattcggtttacgttctcaactaaacatacgttaggaatcgtgtcagctgacggtcttgaaacaattattcacgtgggaatcgggacggttaacctccgtggtgctggctttacgacttattatcaagatgggcaagtcgtacacgctggtgatttactgatgacctttgatcgtgatctgatcaaacagagtggttatgacgatgtggttgttactttctttacgcaacctggtcgcgttacagcacacactgaagattggtcaacagaagtacagcatggtcaatcagcaatgaaagtaacattcaaatagattggagttgtcggtcatgacaacgccgactcattgcgataattgttcgtgttagacttgaggtatcaaataagcactgctcacaaaatagtgggcagtgcttatttggcattcgttaaattgtttaacaagtacggtaccggttagcgtttcatcggtacttccatgccagtgctggcctttgcccgctgtaacaacaagtagtgggccgtgccaaagacggcaccaactagcgcagggactaaccaatccattccgctgctggcaagtggtaagaagctttgaacatgcgccattgcttggccgaaagtactttggctaacgacggcggggaaagcggcaaccatatcaaagacggcggggacgacggtgaagacgacgacccaaacatagacgacacttgacttgtggaagagtggcgaaaggatcgataagaagattagtgccatggctaacgggtaaaggaacatcaggacgggggtggaccaggcaatgatttgatttaagcccacattagcagttaaaaatgaggcgaggcacgtgattcttaaccaggctttgtaactcaagaaatcgaagtgcttatggaagtcctgagcgaaggcggcgacgagcccgatagcggtggtcaaacaagtggtaatgatcaacacggctaaaatggcttgtccgacattacccatgtagtggttaacgatttggtcaaaggcgaccccgccgttatcggataatttgaattgacctaacgattgcgcgcctaacaagattaagagcacgtaaatcaagccttcaaaggccattgagaagaagccagctcgggcggtcacccacgcggctttgttcgggtcggtttggcccatgaaattaacggcagtgacgatagtgacacctaacgccaacccagctaaggcgtccatcgtgttgtagccttgcaagaaaccattggtaaagcctgcggtctgataggcagcagttgcactggtgctaccggcatgagctagcggactgctgaaagctacggcgaagatggcgactaataatagcaaaaataatggatttaataatttgccgacccgagccataattttgctctgttcaacggacaagtagtaggcgagtccgaaaaatgcggcggaaaacagcagtaatgcgagtgattgatactttgctgggaaaaacggtgctagaccaacggtgaatgatacggtggccgtccgtggtgttccaaagaaggggccaattgtaaagtgtatgagaaccatgaagacaacggcaaaggttgcgcctagtggtttaccaatgtcataaacgcccttagatttagtgacacagacggctaaaaccgatagtaagggcaataaaaccgccgtgatgagaaagccggccgcagcaatcccccagtgaccgcccgctagctgacccaagtgaagtggaaaaatgaggttgccagccccgaagaataaggcgaaaatcattgaacttaaggtgacgtaatcacgtttggttaagtttcgcttttgaactcgatttaacatatcaacagcactcccttatttgattgagacaataatcattaaataaaagttgcgattaaccaaaaaacgtcctgatatctgagttagactcagaaaccaggacgtttgaacacgtgttaccaccttagctttgtgactgccttacgacgaatcaccttaaaaagtacggcaagtggccggccacttgcgatacttcggctcaataatgggagcaaccaacagcaactaacatcaagctcgtcactgccactcagaactgattttcaacgatctggtcatgatgtcattgcaccaaactgacactctctaggcatttccagaaggtttactttgttcatcggcgtgtttgttaatcgatttttaatgtggttctaatttacaaccgcgattagtatttgtcaatcttttttcaaaaaaagttagttagctagtgcggattcttaaataaagatggataatagctgtaataaggaaatttgtgaggagggtccgctgatgaccaacaacaatgaggaaaggccccaatggcaagtgaatcagaaccgccatacccgttttcggacgattgtcagtgtcttgcggcgctataacgttttgagcaaccttgcacgtcagaaaaatcctgatcaagtgcgcgcggcgtttgaagaacttggaccgacgtttattaaaattggccagattctttcttcacgtacagatatcgttaagccagaatttgctaacgaattcaagaaattgcaaaataatgtccgggccgatgattttagtgtggtcaagcaaacgatcgagcagcagacagggaagccaatcaatgaaatgtttgcccagtttgacgagcgaccgtttgcatcagcatcaatgggccagacgcaccatgcgacgctgctcaatgggcagaaggtcgtggtgaaggtgcagcatccgggtattgacgccgaggtggccctagatatttcattatttgagcgggcgttacccctattgcgatatattccggaatcttcagttgttgatttgcgcgaaatggttggtgaaatcaaacggtcactgttcaatgaattggataccagtattgaggtaaaaaatggattacggttttaccgattgaataatgcggacgatattattcgggtaccccgggtttatgcgaagtatagtacgcaaaaagtgcttgttaaccagtatatgccgggaacgacgattcagcattttatggcgcaaatgcttgcggccgatgaagacggaaatcaccagtatgatgacgaacgccgctatttggcccatgtcttggtgcaaaatttcttgaagcaggtttttgaagatggcttttttcacgctgatcctcatccagggaatatcttattgcgggaattgcaaccagatgatattgggtatcacgatacggttcccaagcatggcgggaaaattggcaaacggcagttaccaccataccggttagtttatctggattttggcatgatgggtgagatcagtccagctttgatggcaggaattgctaatgttgtcgtggcagtgacaaccgaagatacccatcaagtcggcaaagcaatcttagcgatttcaaaccgaactggcgtggttgatgaagaagcgttctttagtgagttagcaccatttttaagtcagtattataattcgggactgggcgacattgattttcaaggcttgttgtttgaaatggtcaaggtttgtcgcagtaataatattcaaatgaatccagcggttaccatgttaggtaaggcgtttggaacgatcgaaggtattgtggagacgctcgacccaaccttatcaatgatggacgtggcgcggccatttgcgcgcaagtacatccgcgagaattttaattggcgcaatgaactggaagatggcatgttggctagccttcaaagcctgcgtgatgccccgaagattccgtcacgcttattatcagctctagatacgtttgagaatggtcagacgcgggtcaacttggtctttgcacaccgcaagatgtttattgatcggattgattcgatggtcaataagattgtactatccgttattctggcagcgctgattgttggatcatcactactagttcaaagccatcctgataatagttggattacaaacattggtatttttggctatgtttcagcagttgtcgtcattattggcctattgattggaacgctccattcctggtacacgcattggcgacgcaagtaaaacttggcgtagggttaggctatagggccatgcgtcatgagaagttggcaacgtagattcgtctaattgagactgcctaaaatataagcatacgaaaaacagcggtaccgtgatgattccaagccataaaatcatcacggtaccgctgttttattaatcatgtttcagcatcaaattgatcgtggttaatggtacgactgtcaattgctaactagtcttctgatcccataacccgagcacagaatgcggccaagatggcgccgacttctggtgctaagatgtagacccatagatgtgataaggcgctaccaccagcaaaaatagcggggccgattgaacgggcagggttcaaagaaccgcccgttaagttgagagcgacaataatcaagaatgctaaggtcaccccaatggtcaaaccagcaaagtctgcgttaccatggtcattactagtaacgttcagaataaccattaagaataagaatgtgactagtgcttctacaaagaaggccataccactgccgatttttggaaaatcggtttgaccaagcgatgttgcggataagcctaatgcactgacaaacgacttaactgctgcggaagcaacgatggccccaatgatttgggcgatgatatagccaatggcatcggcggcatcgattcgacggttgattaacatcgcagtcgtaacggcggggttaaagtgaccaccagaaataccaccaaaggcataggccgaaacggtaatcgctaacccgaaggctaacccaatagcgaggacgtcacccttatcaatcacaacggttgcagtccctaagaaaactaacataaatgtgccgagaaattcggcgagatacttgcgcatagttgcacactccctttttgaataattgctaacttaacctattttacaatacctgctcgtgaaaacgacggaatttgtttgatttgtgaatatttctgataagatttttataattatattaatggataagatactggtaaaacgttggtataaaaacgttttatggcagttgtggattgttaaaactataataaataaaaattttatttttgcatagtcactattgatagtagtcagtatgattggtgtgtgacctaacgtgactgtgaacgctaattgtcgataatggtggcttctgttttataatggttaggacaagtaagctgatgtttttgaaaacgaattaaatttgtttcacgtggaacagtaaaggaaggtttaattaatggcgttatcatatcaagctctattaacagcagttccggtcgttttaaaagcggggaacgtaccgaacattgtcggtgaagccgggattggaaagtcggccttggtagccgaggttgctaagcggatgggggcgcaattatacacgaccgttgtgagcctgtccgaaaagggggatttagcgatcccagtcccaccactaacgagcgactcatttattcaaacgaagcgctatggccagttggctgacgtacaattcggctatgcacacacgttgattgaaattattcagtatgctgagcagcatcctcagcagccaattttatggtttttagacgaatttaatcgtgggacgcaggctgttcaaagtgaattgatgaatctggtcttgcaacggacgattaacacattgaaattgccagaacaggtgcaattgatcattgctgaaaatccagatgctagtatgactggattcgaaagtagtacgtatggtgttactgccggcgatgcggccatcaaagatcgtaccgtgcgtctagttatgcgagcagatgcggcagactggcttgcttgggccaaacaagtggatgagcgcatgaaccgaccaaacattcatccactcgtccagcagtttattagtgaagatgtaacgcggcttaatcaggctgatgtccaggctgatttaacagcgacgccacgtgcgtgggcgcgtgtttcggctaatttatatgagattgaaaaacttcctgtgcatcaacaaacggctgtggcactggatatctttcaaggagatgtgggtactgagctagggcttgtattcgagcaattcttggaacaacaagccattcatctgacaccagcgatgatttatgacagtcaaccagtgggggccgtggtgccggcaccgattcttaagcagtttacggcgatgaatgaaattcaaaagcgaacggttttggcaagctgtttggctctaacaaccacgtatccgttgacggacgatcagcacgctggtcggttcatgcaactcctacaaacactcagtcaagatggtcagtttgcattggttcaacaaatcggccatgaacgcgacttattaaagcaattatatacagcaaatgttgccaagcaaagtccgtatgtgaccgctttgtatcagtatttacaacaggtcgccagttggtcaaatcagtaagaaagcagtgagtcatcatgattaacaatgccaatgagtacacacgttggcaacaagcgatgttagtgacgccaacagcagacacgatccaggcaggtgcgaccatgattgatcgggccattattgagttactagccaccgatcaattttatggcgagttgctgacccgacttcccagacagttaaatacgacgttaacggcgccgtttatcttagcttggcagaataatcagttggtcttacaatatgcgccaacagtaattgctcgagctttttcacagttttcttacttacaagcggggttaaaacacgtggcactacacattgtctggcaacaccccgttcggtatcgtgatcaggtcaagcagcagccagagttagtgacgttggcgaccgacctggccgttaaccagtatgtcgacggtctgcctaaagatgcggtcagtttaacgactgtccagccgttagtcgatgcccagctaccgcgacgagcagattctggctgttatttgaaattattacagcagcagtcgcggtcgcaacttcagccgaatggcgcgcccaccgccacttcgcgaaataaggaccagcggcagccagcaaaagggtctggcgaccaaaagtcgcaacagttgatcgatgatccaagtggctggtcagcctctgaacagttaacgaatcccaatttggcaactgcccgtttaaaacagttggcgaaagatgcttggcagcaaacaaatgaagctggccgagggttagtggccggcaatgttcgagctcagctcactgtaatgacgcagccggcccagcttgattggcgacaattactagttcggggcctgggtcagattccgagcggtactaaggcctcgcacgcgcgctttaatcgacggcaacccgcgcggatggaaatacccggtcaaattggcgatacgcgcttggacttgcaagtttatgttgataattcaggttctatcagtgatctgatgctgcaacgattactggcacaggtggctactttaacccgattatttgcagcaaccatcaccgttaagccgtttgatgcaatcgtacagcctggtcaaacgtatcaggtgagtttgccacagcagattcgctttacgcgccgtggcggtggtggaaccgtttatcaaagtatttttgatgatttactaacacatcataagacgaatgcgacgaccttggcgctgatcttaacggatggccgtggtgaacggcacgttgagtcacaccgttttacaaatgtgatttggttgttagcgcgggctgaagatcgattgtcgattgagccagcaatcggtcatgtagttaatttgaacttggaggatgaataatatggggacaccacttaatccagatgatatgcaatccttgttaacccatgaccgtcgttatcagcgggccagtgccatcttaacggatcagtggcaacgaatcatagccgatgaagatttggcttaccgacaacagattacgattgacgatttacagtttgctaaggcgttgctagctagtgagacgctgacaagtcaatttgaatttgaccattacgcgggtgtgcaacggttgcgacaacattatggtagtcaattgacgagttcagcacagcactggttagtgcaaaaatatttataagtcaatcgctagttatgacccaaaagtatgactgtgacttatatagatgaaaaaataaagcaagcttttcccaaagtgttcgggagaagcttgcttattttatgcgctgattaactgctttaggttcaacgacgtgctagaaaagccatccaggcttgttgctgcgcttgaatatctggctgactgccttgacggagtcgcgtttgaaggccaatgcgggcttctagcagtgcctgagctaatgtcatactggactgattattgataatttgctcgttagcttgacctttgaggatgaccgcagccatgagggtcaggtagtcgtcataaaaccagctgacggcttgctgaacatcagtatcagtagtaccaaattcagcgacggcgttagccattaggtcaccggctggttgttcggatgtcgttaaatcgtggctaaagagcatactcaggatagctaagggggcggcaccatcctgctctaagcgttgcattgcttgggtacaacgcattaaagtttgttggtgatagcgctggagtgcacgcaggtaaagtgtgtgcttgtccccgatagcgttatataaactttgcttcttgacgccactagttattacgatttcgtccatggaagtatgataatagccttgctgccaaaataagtgcatgattttttcgataacttgatcgtcttgaaatgtctttttagcgggcatgattcgaaccgcctttctggttaaaaataagtgttttaagtataccacagcacacttcattgtttggtaaatgaatattaacgtttgaaattatttgattagggggcttttactgtttttaaagccgattttaattagttgattgtgttgcactttaaaattgataaaagatttccgcattaaatcgattacataattttataaattgaagataatttatgtaatagcttgctgttacaacgatattctaaatatatataggatttcaatatttataattatcaaaatttttaacttatgtgtggtctcatcaaagtctaacgataatataatgttgacggcttgtttagttgaacacgccaactagttggacctaatcggataaatgaaagcagtaggaaagcttgccgttaaactgattgcagtagtttatattaaaatatttgtaatcactataatattaaaaatggctcagaagtccgttaaaataggaattttaatcaatagttaaggggcgtcatcaattgacagcgattccaaaaccatgatatattttcgttgctgatagggttactcacaacgattcactattggtactaagcgttaataatgatactaagcttaagtcaatatctggaaaggatgtggtcatattaattggatgggcagctttcaagacttaggtattagtcaactagtcaagttaccactagtagctgatacgcaatcaggcacttaccacttaacgatcacttctaattcaggtggcaatgcggcggccgataaaattgcgagcccgctacaaggtgtattaccgcaaatgaatgggacccagcaatggattctgttcggtatcggcgtatgtggacttagtttattaatattattaattctaatctggtggcgcaaccgtcaaacaataaaggagcaaccaaaatgaaaaaatatctcggaactctcgttgcaggcatgacactaatggcaggattaccacttgttggccaagctgcagatacggagacaacgaccaaagctgaagttgaattaatccaggatgacactaataaagatattaccttggatcaagcacctggtgttagctttgggaccgaaaaaatcactaatgacagtaaaacctatgatgctaagaacgttactggcgacttgaaagtgaccaaccctgggaatacggacggatggttagtacaagttaaaggttcgaagttcatgaatgcagatgatactcgtgaattacggggcgccgcgttaacttttgcacaagttaatgcaactgcggatgatgctaataacatctctaaagcaaaagcttataaagtggatatcactgaccaaaatcaaattatcatggacgcagaagctaatgaagggatcggtaagtttacgagtaagtatgcaaccaatgaagttagcctgttgatccctgctggtaacgcggctggcgcttacacttcaaccttgacatggacattaggtaacgcccctagctaaccagttaatgcgccagaggagaactgaggtgtgaccgatgaaaaagggattgttggtaacaggtcggttattaatgactgtgataggttgtctcatcattagtaactggggctggtttatcgcaacgcaagctgcaacgacacagtcacaggtgcaggtagaaatgaccccctcggatgatgacaatgcagtttctccggtcgaccctgatgatcccagtaaaccatacccgggtgacccggtcgatgaagacaatgtcgctggtacgggctcacggggaaagttaaccattgatttcgtcagtaatttgaaattcaatgcaattacgaccgcgggtgggccgtttaagacgactgccaagaatgagcgggcgatgattcaaataactgatcgccgcgccacggctgctggatggacgttacaggtcacgccaagcgggttgcaaagtggtcagcagaccttaacgacgtctttaaaattaggcgcagtccaattacggcccggtgctggcaatgttagtactgcacctaacgttgttaatactggtgaattagttgctggtttagcgaataatgtcgtgattgccccgcctaatactggtctaggtacttggctggtcgttctgaatcgtgggcaggtacccacggaacttgaagtccatgatcgccaattgcgtgctggcgactacacgggtacgctggcttggtcattaacgaacgcacctagttaattaaatggtttgatgtgaagctgctacttgtaaagaatggcagcttcaatcatacatagctcgtcacttaccgttgaataaaggaagggtaaagcctatgaaaaaaatattttggcagttaattgccgttgtgagcatcgttatggcaggtttgacaatgactgctagagcggatgacctcaattacacggtccaggctgatttgcctgataaccaaattaatcaaaaagtgtcctattttgacttgaaggtcacaccagggcaaacgcaaaatctcactttaaccattaaaaatagtgatagtaaagaacatcgatacacggtatcacctaatctggcggttacaaataataacggtatcatcgattacagccaagcaaaggctaaggccgatgactccttgaagtttaacatcaagacagcactttcaaagtcacaggtcgtgaccgttcccgctaagtcaagcaaaaaagtcactattaaattgacggtacccgagaaaaagtttgcgggcgtggcgctgggtggaatcaatatcatccaggaactcagtaccaaggcgaaacaatctagtggtggcatggccatcaataatcaatatgcgtacgtgattggcttgcagttacgtgaatctgatccaagcgggatcaaacctgtgatgaagttgcacgcggtaaaagccaagcaacgtaactatcgtaattacgttacggctaatctgcaaaacaaccagcccgttattatgcatggcttaaagatcaaaagctacgtgactaaagctggttcgtctaaaaaattattgacgacgactaaggaaaacatgtcaatggcgccgaatagtaattttgactttgcagttggtgacgggacgcaacaattgaaggcgggcaagtacactttacatttaacggcaacggctgataagggtaagtggcaatttacaaagaactttaccattactgataaagaagctcagactttaaatgatacagctgttacagaaaaacaatcgaactatttctggtggtttgttgcgttgggcgcactgattgttgtcctattaggcgcaattatctggctactattgaaaaaccgccgtcgtcaggactaactagcgagaggagttttcaacatgtggaagggaccgaaacaaatactagttgcattaactgcattaatgggattatgggccgggaccgcccaaattcaggctgctgacgaagcgacgttggcaacggcaccgtctggcctgaatcagttggataaactctttacgctaccagcggcattcagtagtggcattagtaatagtgcgaatattgggaatgtgaccaatgcaagctcgccaaatacgcaggccgttcaggttattaacggcaagaagcaagtggggggcttttggtcgaacgacgccaatcgcctagatttaaataaagatgctacgtttaaaatgtgggtgtatttgggaacatccacgagtactagtaaggccggcgatgggatggcttttgtcctacaaaatgatccaaatggtactgccgcatccgcacaagtcagttcgtccagcattattggtgagacactcggtgtttggggtgttgatacggataataaattgaaggacggcgaagaatttgcgaaaacggccatccaaaatagttgggccttagagtttgatacctataccaatacttcaactagctatagtaatgctggtaagggtgattcgtttgatgatggtattaagaaacaacacattgcgaccgggtatcctgggctggctagtcagtatgaaaatcagtctgtcaggagtttagacgttaccgggataatttggtcaacccggtactactttacgcaaaaacataccaacctagtgacgaatatgtcattaggagatagcaagtggcaccacctggtgatggactggcatgcggcgactaaaacgatgacgtacacttataatgacatcaatccagatgggtcggcgacgggtagcggctttactcagagtgaagtgttagatactagccaattcaacagtagtgatggcctggttcgctggggattcatgggggcgactggtagtaattctggtaataacatggtcgtgattgaaagcgcgccgaatttagttgacgtacaggcggcggttaaggttatggataagaccaagaatcgtgaaatcaagacaggcggccagctcaaagctcagcataaagttcagtacgactatcaattgacttaccaaggtggtcaaattgactgggataacattacggctgaactcaatctaccacagcatattacgtttgacagtgccaaggtaacgtatgcggatggtagtgagcagactttgacggcgccaacgagtagtgatactaaagttgactatactctagataaagcagtatcggctagtcaaccgaccgcgacgatcacgctcaatgggacggccgagaatgtcgttgtcaatgaacagacaactgcaacgacggcgacatttaaaaataaggtgtttgaaacaacgacggaagcaccggattatatgattacagtcgatcagccgctataccttaaaattcgtaatagtccgtatactgtcgccaatggggaagacgtgatcatcagagggattgttgcagccgaggattcggaacaattaactaacggtcaagtgacactacacccaacgcttaatggcaaggaaatgccaacggttcaaatgtcggatgatgacgaacaaggttacttctactacaaggtcaaagcagaggatttacacgtcggtgatgacaatgagattgaactatgggcatctgaccgttacgagaacgtctcaccagttgataaagcgcagattattgttactgcaggtgaacttggttttaagacggttgccaaaagcagcacgtttaaaaccattactttagatggttcggctcaaacgacagaccgggaagacgattggcaactagttgtacgggatagtcgtggtaagggctctagttggcaactacaagctagtgcgactaattttaaaacaaccggtggtcagaatttggcgggcgacgtgattttccgcgacggcgagcagacgaccacgctgaattctgcgggtacggtgattgacagtcacacggctactagtgataacgatgattatgatgtcttggcagactggacgaataagtcaggcattttatatcaaagcaatgcgggagctactccgggttcttacacgggggatattacgtggacgttaacagatgcacctaagtaatgatcgggttggtataagagaatcaaaagcactcacacgcaagattgtgagtgcttttgctttctagttattagccataatggttaaagataataataattttaattaccacagttaagtgaatgaataatcagcctgaatgactgagaacgttgtaatcaaggcatttgtttatcgtgtgattagtgaagtatttacactttttacgtgtttttggttgcgttttctttttactttagtacaatgtaattgttaccaaatacatgttgcacaagcatgattgtgaatataaacacatttaaggagcgatttaaaaatgaaagttattgtaattggttgtacccatgccggcactgctgccgttaatcagattttagcatcaaatccagatactgaagtgacgatttatgaaagaaatgacaatgtctcgttcctatcctgtgggatcgcactttaccttggcggccaagttgctgatcctcaaggcctattttattccagtcctgaacagttagctaagttaggcgcaactgttcatatgcaacatgatgtgacggatgtgaatactgacaaacatgaaattacggttactgacttaaagactggtgaatctaagactgatcactatgacaagttagttgtcactactggttcatggcctgttattccaccaattgacggcatcgatagtcccaatgtctacttatgcaagaactggacgcacgctcagaatttatgggaagcagccaaaccagctaagcgggtcattgtgatcggtggcggttatatcggtactgaattagttgaagcttaccagaagcaaggtaaggaagtcacactaattgatggtttaccacggattttaaataaatacttagacaaagaattcactgaccgggttgaacaagactttgttgatcacggtatcaagatggctttgaatcaaatggtgcaaggcttcagtgatgatggtaaagaagttacggtcaagactgacaagggcagctacacagccgacatggcgattctttgtgttggcttccggccaaataccggcttactcaagggcaaggtcgatatgaacgctaatggctcgatcaagaccaatgactacatgcaaacttctgatccagacatttacggggctggtgactcggttgctgttcactataacccaactaagaaagatgcttatatcccattagcaacgaatgcggttcgccaaggaaccttagttggtttgaacatcttcaagccaacgcggaagtacatggggacacaatcaacttctgggttaatgttgttcggccaaaccatcgtttcatctgggatgaccctagaacatgcacaggccgaaaatgttccggcagccgctgtcacttttgaagacaactaccggccagaatttatgccaaccactaagcctgttttaatgcaattggtttacaatcctgaaactcgcgaaatcctaggtgcacaattcatgagtgaacatgatgtttcgcaatcagccaatgtgatttcagtgatgattcaaaatcacaataccattgacgacttagggttcgtagatatgttcttccaaccaatttacgaccggccatttaactatttgaacttacttggtcaagcagcgattgcccatgcggccgaagctgtcactgaataataagttaaaataacgcgatgcttaccttgcttcatgaaggtagcatcgcgttatttgtttattggtgataattgaatgttaagtggtcggtggtactaaagttaaggccggccagtatttgtgccattaggtcatcgtgctttggtaaaatcaatgtgagtcggttcaactttaactcaacggtaccaaatgccaccaaccgttctaagatttccctgagcgtagttacttgctgataagtagcagtcaggtcaacactgagagttgcttcatgcttagccgtatcgattggggcaaagccgacctgaccgacgaacgcattcgtgtctcgatccgttacgccccaaacaagctggtggtcatgaaaaatctcgcgcatggtgtggttaatttgtgcagcggttgtttccatagtggctgtcgcattgctggtctgatataagttgaaaacgtcgataacgcgcacctttgttaaccaatcgaacgtatagtgtggcgttagaatgggatgatacttttcaaattgtgacatagtgcctcctttaaaatgcgtcatgaatatttagtaattcctattgtactagttaaactgttatgaatcatgattaaaacgtgccatttagttggcttactgttcgtcagccggtgagtgtcctattccgacctccggggctgggtgacaattgctggaacgtaagccgacgtcgatttgagctaacgcccagcccgcgtcatctcaaatacgagtcttattctaagccggaagcaacccacttccgactaagaataatttggctactgagcattgtcacccaacccctccggtcggtaagccgctcgaatggcagatgaacagccacttaacttggtacaatttgtcgttggctattttgatattggaactttaggtgaaatatcagagtgccttcttcactttgccaaaacgttcagttgttactacggcgattcagaataacgagctatcacaatatcatttttagcctaacagttgattgacaaaattactgtttataagaaacaacgacaaagccatcaaaaactgagtacgcacatgtccgccattcgaatactgtcccgactggaaggcgtttcggccaatgctcagcggtgaaattccacttagcaagcgtccttggcttggttagtggaagaccagtatttaagacgtggtcttcggcttaaatctgtgtccactgcgttccagcaattggcagaaatgcctggaagtcggcgtaggacgaactaactaagcaagtttacgctaactcgaactgtttccagcgaacctaaactggctgattttgaactcaaaaaatggcacgttttaatcatagttaatgctagttgttttcgatggttaccagtgtccaaatatgctgatttaagcgtcaagtggactgggattgccttgttgatgaccctcgctgaaaatggcgttaggtcgactaataacgcgtctgctggtgtgatttgcggtgcagtcgtgattgagactgggtcacagtccaataacgatgtaacggcatcagacgacagttctattgtaatatactaacgcgtaatttgaatgaataagacccataatgatggaacagataaaagaccgactaacaagcaatcgcaccgcttgttagtcggtcttagtgttcattgattaaagctttttaccagattttgacccgcttatctggtgccaaatacatggcatcatcgggttgaatgtcgaaggttgtgtagaaatcatctaagttcttaggttgtacgtttgctcggagcttagctggagcgtggacgtcgattgaaagtaagagttgcatgtattcagtcgtggccttcatacgccaaaccatggcccagttagtgaagaacgcactcaaatcaacgtcatcttcgcccttagcagcttcttccgcgcaacttaagcctcccgcatcggcgatgttttcggatacggtcaacgtcccgttaactttcgcaccagcaaagtctaagccatcgaattcactgatcatggacttggcaagttccttgaagtgggcagaatcttcctcggtccaccaattatgcaagttaccgaattcatcaaatagggcaccattgttgtcaaaagcgtgcgagatttcatgagcaataactgcaccaataccaccatagttagcgctagaagattgttctaagctgtagaaaggtgcttgtaggatagcagctggaaagacaataatgttcataaatgggtggtagtaagcattgacggtgtccgcactcatttcccaacgggtccgatcagtggctttgccccactttgagaacatgtcttggcgtgccaaacggttaaagtggaggacattgctcaatacgttgccaccttgttcgggcgtgtgcgtcttgaatttcgtgtaaatcgtttctagtttatcagggtaaccgacttgaatgccgagtttatcaagcttggtcacggctttagcacgcgtatctgcgctgagccaagtgttcgcttgcaaccggcgtttgtagacggcaatcatcttttcgaccatctgatgaacgtccgctttggccgcttcaccaaaatacttgtggccgtaatagagtccaacgacttgatcaaaagttccggtagctagatagtaggcactcttagcttggttccgcggttctttttgaccagacaatgcccgtgaataagtcgtggctaatacccgcatttcatcactgaggtaaccactgtaccgttgaacgagcttagccttcatccagttcttcatcagaccgaagttatcaggattgactacttcgttaaagtgatcgaagaaggcgggttctggcaagatgacgaggtcgggattaccatcgatgacggagtaggtgatagcggctaagtctaaataacgactagtgttaacaaaatcgttgaatttgcgaggattatacatcttactgtaatcggccgactcttctgcggatttgatccacggaacgatcaaacgatcgaattgcagcgtgtcatcaacgattttttgtgcttcgtccttttcgtaaccagttttttgcaacagttcggtcatcattttagcgtaaattgctagtaacttagggccggcctggttgccttcgtcgtagtatgtcttgtctggcaagatagtcccaggtgcttgggcaaataaggcgttgaccttggtatttttcatatcagcgtcgacatccaagctgaatggtaatgggaggccgtcgtagatccaatcgggcatccgttgttgtaagtcagcaaagtcgcttaaactatcaatttgcttgagacacggcagaattggttccgcaccattggcattgcgttggtcgaaatctttagctaagcggtaaaacttaatgaattcggttagctgaggatcgtcgggggtaactgttcccgccgccattgcatcaaagtcatgcattaacgttttttcaatggcatcaactaagtccataaagcccccggttgaagaatggtcatccggaatgacggcggttttgagccactcgccgttgacggcatcgtagagatcttgttttactgctgcttgattaatggttgccattaaatccactccctaataaattttctaatactaagttaattataccttagattattctcagtggtatcatctggtaccgactcagtaaaaaatgatactaatcatcttaatagtcccgaatcagtagcggatgggttgtgaatgttaatgtaaagggcaagattacttctgaattatcggcatgcaggagctgttagtgcctgtaaatcaccttatgaggcagcgtgatggttgacgtaaaagcccccggatgactaacagtgatttcgctagtcatccgggggaagggataatttaattagtagtcattattcagttaataatagctggtcggcatcgttaatttcgatgaccttgccaggcttttgcgtaattaggccttgacgctcgaataaggcgagcttacggctaatgctttcaggggtggtgccgaggaatgtcgccaggtcctttttctttaatggtagtttaaacgtgtcggttttgagcgctgccgctgtttcagtgatatagttcgctaaacgggcttcgacggattcagtggccgtgctggttgtttgacgctccagttgactgagacgtttgccaaagacgtttaagacgttgatgctgatactgggatatttttgcatcaagtcttgaaagtctgaacggcgaatactgcaaacatccgtcggtactaaggcttcaccgaatgaggttcgccgttgattttcaaataaggcagcttcgccatcgatatcaccagtttgtaatagatatagtaactgctcgcgaccattggcagctagctgatagactttaacctgcccattggcaacaatcatcagtgaatccagtggatcgtcagcaccaaataaagtgctgccggctggatagtggtggtgacgaacgatcgattcgatggtgtctaattgttcgctaccgagttcgctaaaaattgggactaactgcacacattcatgttctgccataaggcccacctcctgaataaattcaccctaactataacagattttgcttggtagatagggtttgacgttttaaatttcctgctattttaataactatattgtagcgtaaaacttttttgaatttcttgacggccgtcaagttctggtcaatcaaatccggttatgatagaaccatcaaatgaacgacacggaggtaattgattatgaaaattattatgcaattaggaacgttgacttgcccatcatgcatgaccaagatcgaaaaggccgttgctaaccatgacggcgttgagaatgttaaggtgctattcaatgccagcaaggtcaaggctaactttgatcctgaagtgacgaatgccgatgatttggcacaagttgttaccggacttggttacgaagttgaaaacgtcaaggttaagtaggaggaataaacgatgagtgaactaacgatcgacgaacaatacgcagcggaattaaaacagagtgacattgatcaccatgtcccaacagcgggcgcaatgacgaatcacattttatctaacttaatggttgcttacgttaagttgacccaagtgaagtggtacgttaaaggaccacaatcattggcattgcggacagcatatcaacgtttgttagatcagaatgtccgtcagtttgctgaattaggcgaattactcctagatgaaaaccagaagccatcttccacaacggctgaattaaccaagtattccatgttggaagaaaatggggctttcaagtatcaatctgttgatgaactcgtggccgcaacaatcaaggattttgatacggaaaacctattcgttgaccgggctatcaagcttgctgaaaaagaaaaccggccggcactggcagcttggttagttgcttatcgtggcagtaacaatcgcaatattcgggaattacaagcttatcttggtaacgatgctcgaactggtttggatgaagaagatgaggatgacgacgattaggtcgttgtcgctgaagaattaaacgctctggatagcgattgtgtgggcaaactatccagggcgtttttgctattacaacgggcctgcgctatactaacgacaattaaattatatgggagggccccgagatggcgattagcgacattgtgatgtggacatttgtctttattattgcgactgggttcgtaacggtggtttcaacggcggtactgttgaagcgagcaaaacgagcgcccaaggatgccgagcagtcccacagtgatgacgacgatgactggaaaaaagatgattggaaccatgatgactggaaaaagggagattggaaagattgactcgataagttgcctgacagatacggtgcttaactgagtcaactggcactaaaaagacggtataaccaactgagattggcgacaccgtcttttttggcgttatttggtttttagcagtagatccaaggagtgttcaagattctgaacatcagccatggtcatcgcatctacacaattattaatattacgggcgatgacgagtttcatggccttgtcgatacttgatttcactgctgaaagctgaaccaagacatcttcgcaaggacgattttcgtccatcatacgcaaaacgccgtccagttgaccagccgagcgttttagccgggtcttgatctgcttgctagtgacatattcttcagtagttgccatgattcatgatgcccccttcgtaattaagcaagtgcttttttgagttcggcttcaaaatcaggcttaggacgtgctccgaccatgtgactgacgacttggccatctttcttaatcaggaaggttggaattccttgaacttggaattgactggccgtagcttggtcatggtcaatattcaatgaaacgaagttgacctggtccttgtaagcggggtcttcagaaagggacttaagaattgggtccatcatgcgacatggtgggcaccagtctgcgcgaaaatcaataacggcgataccagtatctgtttctttggcaaaatcttggtcatgtatttctttaatcattttagttgactcctttagtaagtatttgtcactaaacaatatacccccgtaggtatacacgagcaagtcttctgcttctggccgtggagggatttaaaaaggactgatgtattgggtaattagataataacgatttgttgtggaagctagtgtcacctgagaatcttctagttgtgatcgcgagcattaacgttgaagatctcatgttgacgcgagcgtgttatactagcgcttcataattatacaacccagggtatctggtagaattatgttgaattattagaaaccgcttatttaagcgaaataaagcgtttacataaacagttttatctggtatcttcaaattatcatagatgctcggtaccttacgaggaggatttacagatgacaggttcatgggaagcacgctacgccgctgaattttttggcacgctgatcctagtactactaggtaatggtgctgtcgctaacgcattcctgaagaacacgactggtaacgatgatccaggactcgccaatggaggatggctcctggttgcatcgggatatggactgggggtcatgctcccagccatgatgtttggctcgatttctggtaaccatttaaaccccgcgattacgattgggcaagccgtgattggaatctttccctgggcgcacgttgcgccttacttaatctggcaatttctaggagcaattgcaggccaatgcttgattttggcactgtactggccccattatcggcaaacgactgataatgaggcagtcttagggacgtttgcaactagtgatcatgcgaacagtcagttaaacggttttgttacggaaatggttggaaccgcggtcctgatttttggcgccatggggctatatcgcgggatgtttttccatcaaaatatcgatatcgccaatattggcgttggacttttgattgctgccatggttatttcgttaggaggtccaaccggtccggccctaaatccggcccgtgacttgggaccacggctagtacacgcgttattaccagtaccgaacaagggtagttctcactgggaatatagttgggttcccgtggttgccccaattgttggtgccgttattggaatttggatttataagatcttttttggtttataatcgcaattaattaaccgagcgtatttatgaaattattattggtctatcatttttgattgcaatatgataaaacggttcgccgactagctggggaagactagtcggcggaccgttattttttgctaggcctgtaaccaagttggggagacttgattaagctgtggctgcttgaatggttttagttggttggtgcttgtcgaacttggtttggaaattgattaaccgcatagcgttgaagataacgactaagatactagcttcatggacaaacatcccactggccatgtagatataaccgaagattagcccaatcagtaggaaggccacggtggcaatggcgatgaagatgttttcacgagtgttcaagacagtcttcttggcgagaccgtgggcgtgtactaatgcggggaagcttgattgcatcaagacgacatcggatgtgtcaatggcaacgtcagtcccactacccattgcgattccgatatcggcgttagcgattgaaggactgtcgttgatgccatctccaataaaggcgaccgtgttaccggctgcttttagtttcttaacgtattcgactttttcttctggcaagaggttggcgtgaacttcatctaggttcaattcgttggcaacggcttgagcggtgagttcattgtctccagttaacataacgagtttcttgattccttgggcttttaatgcggcgagggaatccttcacgcctggacgaatcgtatcggcaatcccgaagatgagttgaacttgtccgtcgactgccatgataacggttgattgaccaccagcttgtaaatcattgagatctttgagttgagtaggatttagtttgatattatgagccgtcaacattttttgattaccaatgacaacttcttgcttaccgacttgtgcacagattccttggcccttaacggtttcagtgtcatctaggacgggagcgacccccgctgactgctggtcggcataactgacgattgcttggcctaacggatggtcggaaactccctcaatagcggcagcgagagctagttgattatccgcattgtttgtgtaagtgtgcatggttgtaacggcagtgttaccttccgttaaagtaccggtcttatcgaagaccagggtatcgactttggcaaaagtatcgacgacttcaccacccttgatcaggataccacgcttggcaccattcccgattccggcaacgtttgacactggggcaccgataactaaggcacctgggcaaccgagaaccagtaccgtgattgctaagcggaagtcacgggagaaggcgaagactaagactgctaaaacgaggacggcaggcgtataatattgagcaaagcggtcgatgaacttttcagctttggacttggtatcttgagcttcttcaaccaattcaataattttggcaaaagtcgtgtcgtcgccaacctgagtcgctttgatcttcagatagccattttcaaccattgttcctgaataaaccgaatcatcgagttgcttgttgatttggcgtgcttcacccgtaattgaggcttcgttaaggtaaccgttaccttcaacgacgatcccgtcaacgggaacctggctcccggttttaactaggacaacgtcaccttcgtccacatcatcaacgtcgacttcttcggtgccatcatcagtaactaaagttgcggtagttggtgacatgtcagtcaagcctttgattgcggtccgcgtcttctgcaaggtcttgctttcgagataggagccaaacaagaagaggaaagtaacgattgcggattcgttgaattcaccaataatgaatgccccaatcactgcgatactaactaacagttcaatactgaaaactttgttccgaagtgcgctccaagcacgaaccgcaatcggaatgacggcaataattgaagcaactgctagaatgacttggtaaccgagcgtaaattgtaagagatatttactgagcatcccaaggacaatcagaatccccgtaactaatgtaatttgattcgtatgtttagtgagaaataattggaatttcataatttgcaactccttatttgatttgatgaccctagtatagtgagttcagcttgatggcaacttgataggcgtcaagttttgcaaaataacagtattaattctggattgctggcagtgattatgattaaaacatgccattttttaaattcaaaagcagccagcttagacccactggaaacagttcgggttagcgtaaacctgcttagttcgttcgtcctacgccgacctccaggcatttctgccaattgccggaacgtggtgggcacagatttgagccgaaaaaacacgtcttaaatactggcctttcactaaccaagcaaaggacgcttgctaagtgaaatttcaccactgggcattgtcagaaacgccttccagtcgggacagtattcgaatggcagacggagatgtacccaacttttattggactcatcatttttctttataaacagtaattttgtcgagcaactgtcaggtagaaggtaacattttgatagctcactatttcgaaatcactatagtaataatcgaacgtctcgacaaagtggttaatgtaaccttaaagtctcgtttaaaattccattatcaaaatagtcaacgaccaattgtaccaagttaagtggccgttcatctgccattcgagcggcttcccgactggaggggctggatgacaatgctcagtagccaaattattcttagtcggaagtgcctttcttccggcttagaataagactcgtatttgagatgacgcggtttgtgcgttagctcaaatcgacgtcggctgcgttccagcaattgtcatccagccccggaggtcggaatagaacgctcaccggctgacgaacagtaagccaactaaatggcatgttttaatcatgtttcatgacaagttaacggaagaataggtaggatgatcaagtttgagtaaaaaagaggtataggagggaaaaaacgtggattatcaaataacgcaggccaatcaacccttgatgccggcatactttcaggggcgttgggcggtcaagcaaattgcggatcgagacgtgatgtatagcactaatttgggtgctgaaatcgattttcaagtcactgatgctagttttgtgcggttgacattcttgccgttggcgtatgagctaccgagttgggtggcgatccagattgatggcttgccttttcaacggcaggcggtgacgaatgaccccctatggttgacactggatggtcggcctcacgtggtacgggtagttttgagtggtaatactgatgaggaccgtgtgtgggatggcaatcaaggttttacagtgaaagccctgacgacagatggtgagttacagccagtttggttaggccgacacagtgtgacgtggattggggattcactgacggccggctgctgggtcatgggtaagaaccctgccgaagattatcgcgcggaagccaactatgcggcggttgcgagtgacttgttgaatgcacggaatgtccgcattgcttatagtgccgttggtctcagtaaaccaggaactggtggcgtaccggtactgccggaggttttaacagccgtggatagtaaaacgacgtggcaaccagtacccacggatttagttgtgattaatgttggtactaatgatcggcatacggatgatacgacgttcacggtagttttgcgtcgcttccttaatcaggtgcagacgctttacccgaatagccggcttgctgtaatgatcccgtttaatcagaattttgcagcgattattcgcgcggtcgtggccgaatttatgcaattgcaactcattgaaacggctacttggcaactcagtaccacggacggggtgcatttagatttagctggctcccggatggcgggcgaattaacagcacaagcgttgcggacacagtatccagatgtttttaaatcgtgatcaacccatcttataaaaatcccgttttactgtagcaatgttctgctgcagtgaaacgggattttttggtggcactactagattttaaaaataaacgttaacgctggcggtgtagtgattgcgactgtaaataccgggccgcagcgagaacttcttcgggaatatccacatgggcgatgaagccctgaccacggggaccataaccggtgggggtatccactaggcgttgaaattcaccgagtaagagttcagtaaaataagcgggttgccagccagctactattgtgtttggcgtaaattgcattggttgtagccggtttaattgcaaggtcgccggcgcatagcgaataaagttggcattggaccaattggctgagaacgttagggtagtccgccgcgcgagtaacgggtcttgtacgagtaggacgtggcgccaatcggtgggggctaacgcgcgggcatgcgtggcattgctaccggtattggtagaagtcttgtcgaggcggatactaccttgatagccagtctttcgaacaagcgtcgccatcaactcagcctcactagcttgagattttggcaggtttaagttttgccgcaaatacttagtggcgtggccgacgccgcccgcaataatgagtagtggtaattgatagtcttgggctaactggcccgctgcagtggctgttgctgggaggctgttgccacaaaggaccaggccatcgaggtgctcaggcaaggcggtggtgtgtgtcaaccaagccagacattgattgaaagcggtcagttcgtccaattacttggcctccttagtcccaaagtgagccgctgcggccccaaagttgaaccgttggaagtgaacattttgaaagcctgcttgctgaaacatcgttgctaattgttgatagcttgcaaagtgacgagtggtttcctgtaaataggaatattcctgatattgatgggcgaataagcgcccgaatagtgggactacttttgtgaaataccactgccagactggtttaatcaatggctgatcgggttgggacgtctctaagcagaccaagcgagcccccggttttaggacgcgataaatttcagttaaagcttgggctttatcaggcaagttgcggagtccgaagccaatcgtgacgaggtcaaaggtgttgtctttaaacggaagatgcatcgcattaccgcggcgcaaccagacccgatcggcaacctgttgctgggtcactttttgttgtgccagttttaacattggggctgaaaagtctaatccgatgacttcaccgggtgcctgtaattctttagccagcgcgatcgtccaatcacccgtaccacaacagaggtcaagaacatgggcgttagacgctaaatggatttgggccatcgtttgcttgcgccaatgacgatgcgttccgagactgatgatgttattcatccgatcatagttcggcgcgatggtgtcgaacaaaccttggacattatgtaaataacgatttgccataaatgatacctcctgatagttgctttacttactactatagcagatgttagttgccagttaccgtgaaaaggaatgataatcaatataaagctacgatattgatttcgttgctgttaatattgttcgtgaataaaccgttaaactaaagttaaaataacataaaggcagtctcgattggtatttattaagtaccaatcaagactgccttttttgacagcgcgttcctaatcgaagccttaacgtcaaaacgagtacgctagtaatagcttaaaaatcatcatctgcaatttgagcgaacaggtcacgtgatgggatgaagaacgcttgtccggatagtaaagttgagaaagttagtaaaaagtcactttggtcgatcatgttttgcagcatgcctttggtaaccgtccagtgacgggcataaccaatgaagtacgtccctgtgttaccagctgctggattggagtacgggacattcatccgaacgattttttgttcgacaccatcaatttccaattttgaagcaacgttgtgagcattcttaaacttgtcttcgtcttctaactcgaagtcgctgaatttttcgcggcccacggctttttcctgatcctcggtgtgcatatgttcccacacgggcatatcatgttgccatttctgtgcaaaggcgtaagaaccgttgatgaactgggggtcttcgtcaccaactaaggcataatcagcggcatcttctacggccggcgcttccgtaccgtcgataaagccaatgatggcccggccctcgaagtaacgaaagcctttcgtctcatcgaggacggtcgtaattggcgctaagacccgctggaactgcgtttggcattcgtagacgaccgcttcgttgcttgcgcgaatgtggaagaagaggtcgccgggtgttgctggcatggtgtatttgggtccacttaaggtggtgtaggtttctaattctttaggtttgggtgcgccaggaaacaggtaatcccaagcggcactactgatgccgatgctaacttttaattgggtgccagtttcaggtttggcgtcccggatgcgtaatgagcgaatgatggcttgtgaccgatctgcaaattcttgaaagacttcacggtcgtgttgctgatcctgccgatttaattgaagaacggtaaattgaacgtgttcaccgacatccttccagacatcttgggcgcgattgggattgattggcatgatatatttcctccataaattgtttgatattgttagcgtacatggtggtacgggtagcgtcaaataaaggcaaacggcgggtgtgaataatgccgacattcgccagcatcaggggtaggcggccaaactaacgtggtgtgtatcctaatcactaaatggactagtcggttggaatcgttggtgcttgtaagacattaggaattaattgaataaatagccggtaagtctcaattttgctaagtgttggctgtgtggttgcaagttgccaagctaactggtgaagacagttgccgagataggttgccataaaatgccgttgcttaggatggatggctaagctagttagtagctgttgggcaaaaccaacctctaatgggatgacccgctcgcgacactgggcccatgacacgagtaaggggaggcccagatgtgcacgaatcgtcgtgacgatcgcaccagtaatggtcgcgtaagatgttgtcgttaagtcattcaacgcttgtcctaattgttgtaaggcaattaagtattcaatcacaatgatatcttcaatatcctggtgatgacgataaaaagtggcacgtccaacgtgggcatccagacaaagttgtttgacagtcaactcgttgaaggacttttgagccttaaaattcgcttgcagggcagtaatcaatttacgatgagtttgatgagttcgctgatcaatatgcaattgattgttcataattaattttgtcatatgttaatgatacaccaggttgcgatatgtctcaaaacgtcccttttttagcatatgaaagcgtctataatagctgtcacagttagatataactgaccaattaaggagattgtggactaatgaaattaattaccgttgaagagcattttgaatcggcagctgtgactgccgcaatgcgtcaagctgttggtaacgctgcgttaccaacagttagtccagcgctacgccagtacatgcgggacaatttaccgaatcctgcaattatgcaagacacccagcatgaacgtctggcatttatggctcaatatggcattgatatgcaggtgttatctatcaccacagaacttatcgccggaacaagcagttccactctcacaattagctaatgatgaattagcgaaagcagtggtagctcatcctgatcgttatgctgggttagccgttctaccagttggtgatccgcaagctgcggtcgctgaattaaaccgagcggtgacgacgctgggattacggggtgtgttgctgaaaggaaattatcagaataaattttttgatgagccattcttcttaccaatctttgaagcagctgcggcgcttgatgtccctgtgtattttcacccctcatttattccgcaagcagtaacgagtcattattttgaaagtaaccaatggtctgacgttgtcacggggatcttatcatctgccggttatggttggcatatggatgttgggattcaagtgatacggatgattgctagtggtatttttgataagttgcctggcttgaagctcatttcaggacactggggcgaactagtcccactatttttggaacgtttggatgatgagttaacaacatatacagacttacagtatccgtttagtacttattattggcataatgtgtacgtgacgccaagtggtattttgagtgcgcctcagttgcaatttatgttagcggagatgggggcggatcacctgatgtattcgatcgattacccgtataagcagccggagacgagtggaagtttcctggatatcgccgacttgaccgatgaacaacgggctcaaatcgcgtttggcacggcaaccacgttatttaaattataggaggaacgaaataatgtcattaaacgcacaacaaatgcaggcaacccgggatgaattacaagctaactttgcgttgactggtcttacgaaagcccaggtagctgatgatttagggattagttcaactaagctcgatcacttatttgacttaacacaacaatctttgaacgatccgtggatcttacgtaattatttgattgaaaaggtggaagcaggcgggaagacgccggtgccatttatggcattaagtggcgactggcatcgtcattggtttttgaatagcgctgtcattgatcgtcgcgaaatgtcggccggtgattgctaaaatgattggaggaaatcgtcaatgagtaacggaactgatatggcactaattagtgaactagtggctcgtgagcgcttatttcgtgcccggcataaccctgaaatccgagattgctattacgccgacgcgactgtggcaactagttggcaacaaggaccactaagtacatttattggcgcagaatcgaaggaagttgatccgcgctttgttattgtggggagtgtcagtacgcctgtcgttcatctgaatggtaataaggcatacgtggaactaccaaccacgacgcatatgcgcatgatggtcaatggtactttagcggaattagaatcttatcggcgactgatttatcgcgtcgaacgccgtgatactaagtggaagattagtcgattgacctcaattaacgaaagtgataatttacgaccagtcattgcgggacaggatttacacgtgatacctcaagattttaacggtttacgaccctcgtatcaattcctggcctatgtccgacaagctgccggtggtcaaattagtcaggatttattagggacggatcgaccggaagaagttgagcgattgtacaaggaaacgaatgcgtggttgcgagctggagtatagttgaatatgaagttagcgggctatctgttagaacgatagctcgctattttttgtctggtaaatacatattgtgaagaaacaaggtacttgatattctcagaatattcaattatttaaagtatcctaattagagaaataatcaataagaatttaggagtgtaaaaataatcgaacacgatttagctcaccaactcaaagcagcaagaattgacaaaggttactcacaaaatgatattgcaaatatcctaaatattactagacaatcagtttcaaaatgggaacggggattggtatatcctgatttagataaccttattcgtttaagtgatatttatagtattccggttgataatttaattagagttaaccataagaaacaagtagttgagcaaaaagatactgctaacgtaaaagttagtcatgaaaatttgaaggttgataaagttaatgttttaaagtatcaaaatgtgatgaaagggttgctcttgatgatgctttcaattatttcaacattaattgcacctattggcgttttgatacctagttatgtgatatggcgaaatagtaagcataatattttatacaaatcaatcattgctgtttcaattattgcaatagttgttagtcttgtaaattgttttgtgatatacaatgataatttttcgtggaataataaaacgacagtatatccgattaagtagtcgagatgaataattttttgttttttatctttgcaattaacttaataatataatttactgtcccaacctttttgaccattcttagagttactttactattgctgtttcgaatgatttttctactgacaattttgccaatgtaagaaaatgttttaatgtgcgaaactttgatgatcttgtttccttttgttttaatatcgtagcttgccctccaggataacgaagatgtgtgtgctacgtgtagattggcagcgctagctggtaattcaactgaaagaattatagtgagtgttaacataatagtaattatttttttcattaacttaacctcctatcgagtaggttaagttaatgaaaatctttagataagaacctagtaggctacctatgtaacctgctaggttctttagtgatgattagataaaagcgcccgccagtttctaacagcaaccaatatattctttgaagatttgattattagccagataatctagtataacggcaaaattttatagccggaaataaatttatgggaggtaatgtaattatgatgattaatggtcatggctttggcccagactatattgttgattctggggttgtattaattgttttaatcccgctatttttggcaatccttgttaggcaaatttctaaaaaacgcgtgactttttttagaataagtggattgataatgttttttatctatatttatgctctgataaaagtgacgatttttccgatgatgatttttaaatttggatcaaaagcatatcgttatggtttcggaaaacagtatctggctaattttaatgttttggaaattagtaagtacacaccaatacaaatttggggcaatattgcgctaatactaccactgtcgattttgattgcctatctttggccgcacaaattgagtgcgtttaaatttaatatttgtgtaggaatacttacaactattggaattgagatgacacaattaataatggcctttttctatcttggaagtagaacgtttgatataaatgatctcattttgaatttgctaggttacttattgggattttgtatttataaagtgataaaaccaatatttaacatagaatcagatatgtttagagttttttaattaaaggaaaagatatgaaaaaagctattttactaatgactatgatcttatttgtaagtggaacaatcacattaaatgcatatgcagcatctcaaagtgtcaatgtttcatataaaacttacggatcagcgaatggacgatccaatggtaaaactaatggtgtttggcactatttgcgaaatggaaagtatgggtatttaaagattaccagtaaaacaggtgcaggaaaaacatacgctagcttatatcgtagtgtagtcggtccagataaaaagtttggtactgtaagaactagtaaaggttcacataagttttctggaaaactaaataaaacgagcggtagttattatttgatatgttacgggggcaattcgtcagttacaattcatataagaggaaaactgcacgattagtttattaggtaacaaacgaataaatagtatttgttttgaaataacgcaatgttacttaaaaaagtgcaaatgtaacttagaagcgaaaacatttactagcctttaatttccttggtatccactaaaactttgctgaccatccgaagctcatcagttaattcagaggttcgaatccggccaaattcgtcgaggaacttgccaaggcgttcttcgttaactttttcaatgacccgtgctaacttctcacctttggcggttaacgttagataacggtaccgacgatcataaggatcgatgttcaacacaatcaagtcattgttgatcaagtaggtcagtttccttgaaatcgctgaagaagagacgtggcggtcagcggctagctctttcaccgtaatccggtgatcagtgctatggtcaagatagtagagaatcaagaactgttcgaacgacacgtccgcatcagtcaccatcgtttgaataatctcgcgaagatggctttcaagccatgacatgcccactaagactttttcgaacaattccgcatcgtcgtacttggccttcttagtattagtcttcatcattatttaaaaccccattcatgcgtcacgttcaaggcatcatcaacaaccccgtgattacgcacggacttctgcagctggcataacggtgatttcaagatcacgtgtcatttgtttctcaatcgcagtctgaacatcacgatccgttacaactaagctcgacaacttactctttccgttgataatatcttggacgtgttgattatccaaatcatcagcagagacgattggtaagagatggaaattatcattcgttgcttgtaagcattggtcgaacaatggggcgttaactcccataaccaacacactgttttgttgttgtaagactgatgccaaccaccagttcaataattgtgcttcagaatggaagacattcgtgatggcttcttccttgttcactaattgaattgataattcgtggttactaccatattgcttgaccattgctaaagagtggtctggacgatagaagttttctagtgtcacttgtgagttattcgtccggtcaaggtactgagtgactgacaagaacccggcagcatcgtacacatcccgacgagttgctaatgacccattgaagtaagtcatgtaccaaatggcaccattcttacggtacttcaacgtcataattgggttaccgccatcatcggcaattgacacaatctgcttatcagcattgcgcttatattgccatgcaggattatcaggtaattctggtttagtcttcgcaacggcacccggtacctttgcctgaatcgtgtagtacatgttgtacaagccagttcgtttatcaactaagccagctgattggtaactgttccaaatttctggcaagctgtcattatagttaaccgtaataacattagctttatccttaacttcactcttcaataagcccatgatcatttccatcgaagccttttcatcaccagacaatgattgaatcagatcggtgctgaacaagaagtactttgcagactggtcaaattcgacgggcgatactaagtgagtcgtcccgtaatccgattttaacttggcatcaatgctttcaatcttttgttggagccccttaacaatcgtggcattttgatcataatcatgttgtaatcgattgattttctgattaatcaagttgagtgaacgttcttgttcgtcttgagcactcttcttcttacgatcataagcaactaacgcatcttgagcggtatgtaagtctttttccgcactcgtaatcgcgtgttccttccgcgaacgttcacgggtttcagtctgttcacgcttctggagtttcacgagttcactgttgattgcgtcactcttttgatacagatcctgtgcttgcttctcctgttgcttcatcaacacgaataacttcttaagatcctgttcgccctgaattgctttacgcatatcagcttcattttgcttcaaatcagctaatgattgttcagactgcgtaatcttcttttccaacgatttgatggtttgatcgctcttagcaagagctttcttagcatcatcataacgtttttgagcagcattgatggtcttgaccattccctgccgttcgctatcgttcgtgttaacgactttgtcctgtttagacagagtaaccttagcgtcctttaactgttgttctaagtttaactgttcggcaactaaagtttcatactgttgcttttcgtgcttacgatcctgaactaattggaccttaagctccccacgtaaagtttggtattgcttgtttaagtcagccatttcgcgttcaatggccacactgtttttggctgctgtttgggtagcacgccgttggttgacccggttttggcccttaactggggcactagttgaagcagtcacgctgctactagttggccggacaccagcagatgaccgcacattgggggtcgtactactttgagtcgcctttggttttggcttttgagcagcaacggttgaagtcgccgttgcacgctcagaatgattacggtaatcctcattcttatctctgcgctttttattgaacatcttcataatgcaactcctccataaacttgattgtttgctcaaagagtagaaaggtcatcgctgacctttctatccgttcagcaaataatcaagctattctaattattatgcttcatgcttccgacgagaaacgccaaagtatagcgctgaacccatcaataaggttgaaagacccaagacagccaaggcagtcccgttttcgtcttcatccgtttgtggtaacgtctttgcgtctgaagtcgtcgtcttagtcgtaactactggcttcaatgaggctgatgcaggaacaaccccactagtcccattgttagtagtagccgtcgtcgttggcgttacttcatcatcagaaaccgtggttgctggtgccgttgaagtcgtcgttgatgaaccgttgtttgatgaaccattaccattatcaacagtatcgtcacttggcgtcgtaacaggagcagttgtagttgtaccagtaccgccaccgttgacgttgtcaccagtgccaggtgcagtcgtaggtgcggttgtcgtcgtgccaccaccgttattaccattgtcaccggtaccaggtgcggtggtaggtgcagtcgttgagccgccgttatcattcttagcataagttaaggtgatcgtcgcgtcatcagccaccgtaccactcaaagcaccatcagctgacttgtaagtgtaaccatcgattgaaggtgttgcgaccgtgtaagtgtccccaactttgtaagttgtggtcgtcgcactcttgatcgtattaccatctgcgtcaacatagttaactgtgatcgtcttagtttgttcagttggagtagtgccaccgttcttcgtgtaaacaagggtaactgtgttaccgttgtaggcaatcgttccggcaatggcatcaccagtggcatggtcataagtgtaaccagcaatttctggttgaccaaccgtgtaagcttgaccaacgatatattcagttacgctggatgctttgatggtgttaccatcagcgtcaacataattgatcgtcaagttagctttattttcaactggtgtcgttgaatccttggtgtaagttaaggtaatcgtcttattaccatcaaccgtaccagtcaaagcggcatcagctgacttgtaagtgtaaccatcgatcgttggcgtttcaaccgtataagttgagccgttatccaaagtttgggtcgtagcggccttgatcgtgttaccatcagcatcaacgtagtttaccgtaaccgttgattgttcaactggggtggcattcttggtgtaagttaaggtaatcgtcttattgccatcaaccgtaccagtcaaagcggcatcagctgacttgtaagtgtaaccatcaatcgttggcgtttcaaccgtataagttgaaccgttatccaaagtttgggtcgtagcggccttgatcgtgttaccatcagcatcaacgtagtttaccgtaaccgttgattgttcaactggggctgcatccttcgtataagtgaaggtaaccgtgttaccaccagaaacaaaagtcccagtttgggttgcatcacccgttaaggtataaccgtcaatcgaagcggcatttacactgtaagcaccgccaacttcagctgcagtaccatcagcaccttctgtataagtcttagaaggtaagatcgtattgccatcagcatcaacgtagttaacagtcaagtttgaagcttcggtattttgtgagtagactaacgtcaattcagtaccagcagccgtcacattaccatcagaatcagtggtgtcagcggcaactgttccagtcaaagcactggacttagtcgtatctaacgtgtaattaatgaaagtagcaggtgtaacggtgtaagtattgtcaacatcgccttgaacagtcgtgtcatccgcaatcttattgccgttttcatcaacgtaatggacaacgaccgtaccagcggcaacagaagtatccattacttgggttgcatagctccaagcctcaatctgctgattggcatcagtgttgttagtattagttgataacttattaactgaggtagtccctgtaaattccaaatatgcagcccggctacccgtcgtcgcgtcgtcgttagctttgaaagtatagagaacagtgacataactatcagcatcagttagcttcgtgatgtccacagtggcagttgaagcaccagctgcgtaactgtattccttaccggattcagttgcgtattcaacggcagtccaagtgccattactgttggaaccatttggcgcaattgaaacttgaccagaagcattagcccaatcaagcgcttggctcttggttaaccggatggcaactgcgtacgtatgcccggcagtaactttgatgttcgtgccatcaacattttcctgaatgtattgtgcttggtcttgtaagttgcccgaaccacccgactgagtagcactcgtcaatgttccagcgtcaactgagccagcagcagtttgattagcagcttcagaagctggtgccgttactgttggggctgtagtcgcagccgtggtcgtagcagttgtggttgccgttgctgcagcagaagctggtgttgcaactgatgccttagcagccgttgctgcaacagttgccgttgaagtcgatgtcgcatcactgcttgctggtgtagtcgcactgacagttgcagctgaagaactagccgcactcgttgttgacgtaacagctgaagaagcagtcgagctggcagcactacttgaagtagtagcagttgagctagccgtacttgacgttgaagttgcagttgaagatgcagaactggcatccgtagcagctgatgaagtcgccgttgaactagttgcagcagagctggcagcactagaaacttgttccgtggttgcgtctgagctagcagcagtatcagcagaagcattaacgttggcaaatactaaacctgcagccaaagctaacgtggttgcgccggcataaacccaacgcttgccatctttatacatctttacccgataaaccgaatcaccggtcattttttgattatcttttgacatatggaatcctccccgagcacccacgattttctgcatttatgtaaaatgatgggcgacaaatcgcttgccagcccatcatcttagtcgtgcttatcgtgtcgtgcttaataacaccataacgattttgttggcatttcagttatatttaacgaattagcccttgaatgcggcaataacgtttaagataaaactgtgtaatccaccaaagatgtcgttggaaacacttgatgtatatgatgatgtgtgtgtacctggtaaaatatgaaaatcattgaaaaaactcatgagattaatcccctttaattgttaattaattagcctttgaatgcagcaattacgttcaatacgaattggtagaaagtaccaagtggttggttgctaacgtagctggtgtgtgatgaagtatgcgtacctggtaaaaagtgtaaatctgaaaagaaactcataatgtatatcctccctcattatctaaataatatcaagacattaattaatatattaattaattagtttatcgaaatagattatcccttgatcgctttaatgacgttcaagatgaagctgtgcaagccaccaaagatatcatttgaaacacttgatgtgtatgatgacgtatgcgtacctggtaatacgtggaaatcgttaaagaaactcataatataaatcctcctaaaagattagttgtgattacttgctgaataagctcttgattgcaggaatcaagtttaagataaagctatggaaaccaccgaagatgtcgtttgaaacacttgatgtgtatgatgacgtatgcgtacctggtaatacatggaaatcgttaaagaaactcataatgtaaatcctcctatgattgtttgactaaattactttttgaatgcagcaatcaagttcaagacgaagctatggaaaccaccgaagatgtcgtttgaaacacttgatgtgtatgatgacgtatgcgtacctggtaatacgtggaaatcgttaaagaaactcataatgtaaatcctcctataattgtttgactaaattactttttgaatgcagcgatcaagttcaagacgaagctgtggaagccaccaaagatatcgtttgaaacacttgatgtgtatgatgacgtatgtgtacctggtaatacgtggaaatcgttaaagaaactcataatgtaaatcctcctatgattgtttgactaaattactttttgaatgcagcaatcaagttcaagacgaagctgtggaaaccaccgaagatatcgtttgaaacacttgatgtgtatgatgacgtatgcgtacctggtaatacgtggaaatcgttaaagaaactcatgttgaaatcctcctataaaattaactatgattatttgctgaacaaactcttgattgcaggaatcaagtttaagatgaagctgtggaagccaccgaagatgtcatttgaaacacttgatgtgtatgatgacgtgtgggttcccggtaagaagtgcaaatcagtaaagaaactcatgaataactcctccttttaagttagttaatggttaaatccccaagcctagccacttgtatggcaagacttgagagtttggaaaacaaattaaattccgacaaacttgattaaacggttagaaaattcaactaattaatcattgaattccctaacacccgtctctagcaacgcttaacctttgattgcggcaatcacgttcaacacaaactgatagaaagtaccaagtggttggttgctgacataactagtatgtgatgatgtgtgggtccctggtaagagatgtaaatcactgaagaaactcatgttaatatcctccttagaaaatttacaaattgttcacaaattagcagctcaataatcattaatttaatttagtctgttaaataactaatattgattactaatgcgaacgtgaaacaagtaacctcgtttacgatttaaatattaactaattcgccccacaatcgtcaataaaattactaatatttgaataaatacagggcagtatcatattcaatcagtaaatgtgtatactatggacaacttacgcgtttcattaacggtcaaaatttgtgtccaatatcaatattatttatatttatcaccagttaactatgccagcagaaagcgtttaaacccctgataatatcagcatttcagcgtagttacttggtgcgacatcccctctttttttccgaattatgaaccataccatcgggaaatttattccctaaaaaataattataaatattgcttttttcgacttattattaaaattattaatactttttatattttttacggcggttttatttcatgccttaacccacgttatccagttgaatacatattttgggatcaaaaaagtggctattgccaacactcagcaataaccacttactaattttaataatcaaacaatatttcactaaggccttttttaaccgtgttgatactgcagccgataaaagtcacgataacgttcatgggttgctaataaggactcatgattgccatcacccgtaatctgaccatcctccatgaagagaattcgcggataagcttcgatctggtttaaccgatggacaatcgtaatagtcgtcaggtcagctggtaacgtcgccaagagctgggtcacccgttcttggttctgattatcaagactagccgtcgcttcgtctaaaatcaataacgacgggtggcggacgagtgcccggacgatggccaaacgttgtcgctgcccaccagaaacattcaagccccgttcaccgacgtccgtatcaagaccagctgacagttcagctagccagtccgctaagccgacttgtgtcaacaacgcactcaattgttcatcagggacaggttccgtcgaacctaacaggagattatcgcgaatcgtcccgggcatcaagtctacttcttggctcacgtagccgatctgattacgaatcgagggaatcgtataactggccattgtctcaccgttcacgtccagctcaccacgagttggcgtatagtaagcctctaaaagcgaaactaaggtcgttttcccgctaccactctcaccaatcaaggcaatccgctcaccgcgatgaattgtcaaatcaatgtccttaagcaccggtttatcactttcgtagccaaaatcgacgtgatcaaagtcgaccgtatcgattgttgacagcgtttcgcctgacaaccgcttatcttcttccggactatctaaaatgttgtcgattcgctcagttgccccgaccgtttgttgcaaggcagtcactaagccagttacgctactcagtggtgaaatcatttgaacggcatacattaagaaagctactaaacttccaattgtcaacgcgttcgtttgtaccaagatcccaccataaacaatgataatgaaaattgcagccagtaacatgatgtttagcactggattaagcaccgagatcagcttgatttgacggacactgaagcctttgatccgatcaacttgatcttttccctgttgtttcagtgccttttcagcaaccattgctttcactaaccgattttgaccaatcatttgtactgctgcactatttaagttggccgtttctttttgaatcgctttggagatccgcgctaacacttgacccattggcacaatgatcacggccatcaatggaaccacaattaaaataataatcgttaagcggaagtttaataacaacattaacgtcaaggaacccacaattgagatgatcccattaatggcattcgaaaactgacttgaaatcaattcaaaaatcgtcgatgtatcgttaactacccgactagacagttcccccgtccggttatggtcaaaatacggaatcggcaagtccacgatatgttgccataacgcgctccgcaacgtcgaaacggcgtcgacccccgtataactaagtagaaaactcgacgcaacactagcaaatagctgcacgacaatcacagcgcctaaccgaagcaacagttgacccgaagtaccatggttaaaggcgtcgataaactccttcaacatcaacgtaatgccaagactacaaatcgttgcgacaaacgacaacaggattccaatcacaaagagtcccttcttcgggtgagcatgggtcatgatcaatctcaataaatcacgggtcccatacttggcatgtggttgtttagccgatgacgtgatatgcgtttccattggttgtaactcccctcattgcttgaatatcaggctgaatgacatgatcattccaccgttgccaaatcatagcctcagaaaaacggctactgttgccatatgcccgttcactcatcttcgccaactgtttagggtgttgtaagagcgttaaaatcaccttgcccaattcaactaaattattgggggtgatcaatcgcccattttcaccatccgtaatcatcgttgccggaccatacttaatgtcataggcaaccaccggaacgccatgacttaacccttctaaaatgcctaagttaaagccctcatattggctagtaaggaccatcagttgtgcttggttatagaccggtgtcaaatcgcgctcaaagcccttaaacgtgataaatgactgccaacgttgcgaactgaccaaggctcgcaaccgattttcttctttaaatccagtccatgaatcaccataaccataaatatctaaggtcacattcgactgtttttcatgaacataggcgaccgccttaatcaattgttccaaatttttctctgccgataagcgagcaacggcaatcaccttgccctcaatccgatccttaaagtcaaccggacgagctgctaattgttcgtcacttacactaccaactggaatcgctaaagttggaatcacattatgaatgtggttcgtcatatcatcacactcttcttgcgtggacatgatcaaaccagccatttgactggcgtgatctaacccgatttgagtgtacggcacaattggtgagttcacaacgtcaagtgggtccagcgtgaaattactgtgtaagaactcatacttgcgcgctgctgtggacattttaacaatcggattcattccagcatcactacgatccacgatcatggttccgtgaccgccatactcagtatttaacgcgtctaagaaaaaggcagtcagctgatcccagtcctcaaattcgtaattatgcccgtgatagtttaacagccgttgatgagtggcaactggttgttgcttctcatttggccggaaaaacgtctctaagacaggctgttgttgtaaattacagtgttgctctaacacaatattctgcttgtcatcaaagtactgggccaccgttaagaagccccgcgtatcataatagtctcgacggctgaccgcgccctgtggattgagaatatcgacgtaatcaatattcccctgcgcatttaacattagtgctttttgccgttgttcccgttgaatgacgtcaaattcattagcgctgacccgttccagcgtttcacccgtcacccgtggataattggccgcagttaacggttcgccttcgtaattcgtagtgccttgaaaataatcatacatattgacctggaactcatcatcatacccaatgagttgcatattatgatgtaaatcgcgtacaaagttacgggtcacgatcaacgcaggtacccggtgctttgtgaataatttttgacgctgaatcatggctaactcaatagctgatggcgtcgaatcaattttgctcgtaataaagaaatacatttgctacgcccccgcttttattcatgtgataaactctcgactggatccaaccgtgccgccatatgtgccggtgccaaagcagccaataaactgatgacaacactgactgtaatgccgcccagcattgctgccccggagattcgaacgattggatacttaattaagctatagatggccatattgcctaagaattgccaaccttctccaaacagtaaccccataacggcggctaataccccgatagttaaggcctcagcaaagaacaaatgactaatatcgcgtttgcgggcgccaagtgcgcgcaaaaccccaatttcacgagtccgttcagaaacgctgacgtacaggacaacaatgatcataattgctgagactaataacgcaataccagccaccccggtcaatacgttagtggctaaacgaatataggtattcaatgaatcaattaaatcaccgattccggtatagttatactgttgcttcttattcgttcccttgattgccttgatttggtgttcgacttgcttaacattcgccaatttatctatttgaacaatggcaaaatttggtcgataagccacattcttagcagttaacatctttttgacggtttgtggtaagaccacgacgctagtatcatcgctacccgtaattccgctgacggtcagcgtctgactgaccgttacggactgattcttgcgattaaccgttgccaatttaacggtcaacttcttattgagcgcttgttgataatttttcttacccaccatcttcttagctaacttacgaccaatcaaaacttgaccattttcaggacgtgaaccgtccttaattgtcttactcaaaattgtggggttatccgtctggagactggccgtcacggttgtttttttataactcgcttgtgtgctcgtgtaatagcccagcttagcagacttaacatgtttgatagccgctaattgtttgacgtttgcagtcgtcacttcggcattcttcgcggctgtgacttgttcttggttaaccgctgctttgtaagctgctgcactggttgcttttttacgcgcagccgtgctgactttccccgtcttcttcgatacttggacagcggttggattaacttgagacgtaatctggtgattcatataattttgaatccctgatcccaagcccagcattacgacgatactactgatcccgatcgacgatccaaagataatcagcaggtaacgaagccacattcgacgcatatgttgcatggacatccggaacatctgccgaaagccaagtgttcggtaacgcgtcggttgcttatcgaccacgtcgaaaggcgccccgatcactaattcgtcatgaatctggccgtcatccaaatgaacgatccgcgtcccgtagtcagccacttcctgcgaatgggtcacggtgatcacaagtttaccttccgcagcgattgagtataaaatatccattacttcttgggtattttcactatccaacgccccggtcggctcatctgcgataataatatcggggtcactggctagtgcgcgagcgatggcgacccgttgcttttgaccaccggatagttcatttggatactggtgcgtctgctgctcaagtcccacccgcttgagtaggtcctgtgcttgctggacttgttgcgcatgggacgtcttagtcatctttaatgaaagcatgacgttatccaagacagttaggtaacttaccaagttaaagttctgaaagataaacccgattgtctcccgacgataccggtccatttgccgcacattcattgaacgcaaggattggccgtctaacaagacatctccatcataatgatgatccaagccaccaataatattcattaacgttgacttaccaccaccagactccccaagaatggaaataaactccccccgttcgaagtttagattaatgcccttcaagatgacattctcttggtgatttaaggtataggccttacgaatatcgtgtaattctaaaaagctcatatatgtacctccactattttattaactacattccccacaatgtatttcctcattaataacattgcgatttttggtgaatgatgtaaagtgttattgaatacctgtggtcatcattcataattaaaattataatcatcctaaatcctaataaaccgcctacttggtagttacaatttgtaaaatatcacccattttgctgatttttacaataaaattttttctatttcgaacttattttatgacggcaatcacgacttaaccgtcagcagagataaatccaagcaccccacacattcaaggcatgaactaaaaagcgtcaattactaggcacactgactgccagtaacggacgcttcatcgtattaaattacacctaatgactccaacttcaatcagcaggattcctacttaaaaaaggaccgcttcgtgaccacgcggtaaatcgcatccgctaaaccagtcacaaatacgacaatcagccctgcaaattgcaaccatggcaattgttgcctgattactgtcacttcactccccagccaaaagactagtaacccgagaacaataatgatactttcgataatgtttaatttacgcatctcaaactcctcacgtacatcacacatcgttgcgagcaactaccatgcatgactatatttgtcctttaacacctaatctattataacccgtctgctgttaaatcacatgccaaccactcacgattaaactcgagataggtcggcagatttttcattgcgtgatgtcattcaaagttagtgcgaccagtgcggtcaaaaattacgagcgtcaccatgttaaattagggtcatcttgcggacgtagcgattcatttcgccaacaacgttgtgattcataaattttagattagcgacgacgctcaataacagctacgaacacagcgtcagaaagacaagcaaaaagcccccaaaacaagcagcctatcagccagctgatagttgtttgttttaggagcttccatcttaatttctaaagtgctagcaccttagtcactaagacgtgcggttaacttcttagttaattcttcgtaaccaggcttgccaagtaaggcgaacatgttgttcttgtaagcttcaacaccaggttggttgaatgggttgatcccgttcaagtaaccagaaatggcaactgcagcttcaaagaagtacatcgtgtaacctaacgtataggcatcctgtgaaggaatgttaacgaccatgttaggaacaccgccatcaacgtgggccataataaccccttcgaaagctttggtgttaacttgagccatcgtcttgccttcaagatactttaacccatcaaggttttcggtttccttaggaatgtcaacatcactagtagcgttgtcaactttaacgaccgtttccatcaagttacgacggccttcttggatatattgacccaatgagtgtaagtcagtcgtaaagttagctgatgatgggtagatccccttttggtctttcccttcagattcacccattaattgcttccaccattctgagaacatcgccatgtttggttcgtagttttcaagaatttcagtggtgtagcccttccggtacaagatgttccggtaagcagcgtattggtaagcttcgttcttagataaatcggcatctttgtattcattttgggcatccgcagcacccttcattaatgaatcgatgtcgccgcctgataccgcaattggtaacaaaccaactggtgtcaaaacagtgaaacgaccaccaacatcatcaggaataacaaaggtttcgtagccttcagcgtcagcttcttgcttcaacgcaccgcgcttgcggtcagttgtggcatagatccggcccttagcagcttcttcaccatacttcgcgattaaacgttccttgaagacccggaatgcaattgaaggttccgtcgtagtccctgacttcgaaatgatgttaacagagaagtcacggtcgccgattaagtgaattaagtcgttgacgtatgaagatgagattgagttcccagcaaagacaacttgtgggaatttacggtcttcacgtgaaagtgatgaccagaaagtttcgtgtaagaattcaatggctgcccgtgcaccgaggtatgaaccaccaatcccgattacaacgaggacgtctgaatcgtcttgaatcttctttgcagcggttttaatccgtgcaaattcttccttatcgtaatctgttggtaaatttaaccagccacggaaatcattaccggcgccggttccttcacgcagctccttatcagcagctgtgaccatagcttgcatttcgccaagttcgttatcatggacgaacttagttaaattagagctgtcaaatgaaatgtgtgccatttactattacctctttctatacgtatttacatgtcatattatacaatagctcgcctaataatgaaaagcgcttcctcccttttttcgtaaattttcgtcatttgtgtaaaaaataaatacaattattaacaaaaaaggtgctgataacttaccgttaccgcaccttcaacagatttttttaatctgtaaatcaaataattaattttttagtaaagctttactaagccttcattaaggataacgcgaccccaccaacaatgaccaggatcgagccaatcaccacgtaaaccatttctcgcttcgtcttgtgctctcctaagaggtagatactcccaaacgtcgaaataacaattcccatttgcgaaagggagtatgcgacagcttgtccgatttgggccattgccataaacatgaatagattcccaataccccagaccagaccagtgacgatattacgataagttgctttaacaacccatggcttatccttaaaggaccagatcaaagcacccagcaacatcccaacagcttgaggcattacaactgcctgtgcattgacgttaccataatggaccacaatcgtatagccagcgtatccaatcgttgataagatcaaggcacgaatcccaacaccccaattttcagaagcactacggttcggatcagtcttatcagttaaggaagttaaaacagccccggcaatcaacacaattacagaagcggagccaatccaatacatgtttccgtgccattcattgaataacagcacaccggccaacgcattagcaaccagttgcatcccagttgaaatcggcgtagtccgtgaaataccaaccgccttcattgacgtaaattgttgaccttgaccaatactccagaataacccagagacaatcccaatcaaccaaattttgcttgttaaagttggctgttctacggcccagagtgccaagccaaataccaaggctcccatggtcatcccaagggtctgttgccgagcggtaccgcccattcggccactaattaagccgatactgccccacgcaatcgcaggaatcagtgcaattagaattcccattactaataatcctcatttctatgttttctctcttgcctaacgacaaggaattattttaccagttaagtaaccgttttaccagtcacaatcagggattcagggttaaatataattatttttatattttcatgaattcgttttcttagcgatagggaccgttttcaattaatgaaaacggtccccgaaataccctttaaaatttttttctattccacttaaattatggcgcacacactacttatcgagtgtcaaaaccagaaccttcaaatagttgcttgccaagtaagccttgcgcgtcacgaagtctgctggtaaccggaacgtctcactaagtgtgaagtgccgatcactgcccacaaaggccgccgtgaccgcggctttaaacttcttcattgaaaaattattcgcagtcgttgcaatcactaattgcccatcacgccgaacaactggtaaggtcgctgtcaataagtcagttaaatcagttgcaacttggaacttctgctttttcacccgcgcaaaagtcggtgccgttacgacaacaacgtcataacttagtcggtgcttctgggcgtaatctagatagctgttcacttcgattgctcgaatttcctgcttatcagggtcaatattattgaccgccaattgatcagcggtctctttggcacccttcttacttgtttcaatggaaatcgtcttggcagcacccgcaacggcagcagcagccgtaaccccattttcctggctaaacaagttcaagaccgtcttaccttgcaattcggctccggccaaccattcccggatgggacgcatatctaatagtaacccggtcgttaaatcatcagcaaggtgtaatggatacgtcaccgcgccttcagtcactaataacggctctggtgctgcttcacccgtgacgagttgactctttaagttagcttcttcgacattaaatcgtaatttcgcatagatgcctttaaattgatgttcagtagccgcttcaaaagccgcatagatcatttcgcgttgctggtaaacaccttgtgcgtaccatgtaaagacatagtaatcttgataacgatcgattgttaacccgccgagaccgtcgccatccgcattgaagacccgttgtggtaactgtggatccatgctcgttgctcgccggaccaacgcctgtttgaataacttacgaaagtaatcggtcgttggcgtctcactttcatccaagctcaagacccagcctagttgccgacgatgcttcgcaatcagcgcgtagcccataaattgagaacttgccattaacgccacaaaagagccatcggttagtttcatactcggatccttgagatcatcttgtacgagtaaaggatagccgtccttgactttacgttgcgaatttcccgtaatctgtactctttgcatagttgttgtttctcctattcatttcaaatcttatctaaactattgataaatcgctgtttgcagccttgttaagggtaacatatttagcctcagagtgcgaggtagaacagtgtcaatcgctgaaaagtattaggcttaaggtccgcaatcgattactattaaacgtccgttcctactattaatgatgggttattgctatggcccaccgttaccccgcattagcaaaaccgggcctcgagatcattacgatccccaagcccggtccgtacggatttacccgctttaaactatcacgttaatcatcaataatcggtttatcaaaaccttcatctgggaaagtaacggtaaagcacgtcccttcgttctccacactgtcaaccttgatcgaaccaccatgttgttggactaattgatgtgaaatcgctagccctaaacctgattcaccatacttcgtattctttcgtgatgggtcagccttataataccgttcccaaatatttttgacttggtccggtgtcatcccaatcccatggtcttgaatcgcgacaaccgtcgcatgatccgtacggctacccgttacttcgatcacgttagcttgtgaaaactgaatggcattctgcatgatgttaaacaagacctgaacaaagcgatcataatcggcccatactggcagtttctcgggaaccgtcagcttgaattcatcatccgcggcggccgctttctttgtgagctgttcaactaagttatgcaaaacctcggcgccatcaaaattggtcttgttcaaagcaatctgtccggttcgaattttttcgtaatccaagttctcattgactagtcgaatcaaccgtttcgtctcattttgcatcagttcaattgaatgacccttgtcttcttctggaatagcatcgtacgctaacccttccaaaataccattgatcgtagtcaacggcgttcgcatctcgtgggccgcatcggccataaactcccgacgccgcttttcctgtcgcttaatttcttcattggaagttcgcagggagttgaccatgccgttgaaatcatccgccaagtcatcaatctcatccttatgattactgtcaacttgaatgtcaaaatcaccatttgcgaccgaatgcgtcgcgtaccgcaatcgattaatacgacgaacggaataacgtgccaaaatgtaacttaacaacagagccgcaatccctgagactaacagtgcaatgaacagatttttttcgatctgctgttcattggcctgcaaggtctgttcaaacgacccaatcgagatggccccaacaaacttcttcgttgctccattcttatagaaaagtggcactaaaacgtcaatggttcgcaacgacggtgtattcacgggttgatcacgattgcgtgttctgaacgtgacgtggggcgactgcgtaataatcttattccgcttcagcttcttccaatctttggctgagatcttgggatcataaatcgagccaccgggggtcccgctcattgttgtccccataccacttggatagaccaactttttgttagcatcatataccgaaaagtgaatatgttgatctcgtaagatgacggtcccatcatttagaaattgttgattaaacccgacaacttgattagtcttcgtattataccgaatagcttccttttcaatactcgcggcgtactgctgcaattgttgccatgagttttgataaagcatcgttctagtcgttcgaataaatgaaaatccgaggacgacgattaccgtaataatgacggcaaagaacgctagcatttgttgataaatcagtttcattgagcgtcaactccactatcatcaaacttgtagccgaccccccaaaccgtctgaataatttgtggcccagctttttcaatcttttggcgcaattttttgatatgtgcatccacagtacgttcgtcaccataatattcatagtcccagaccagttgcaaaagttgttcgcgtgagaaaacttgccgcggcttttgagctaaggtcttcaataaatcaaattctttgggggtcaagtcttgaatttgtttgtctgctaaataggcttcccgcgtcttggtattcagtttaaaatggtccgtctgaacatcaaaggaactcaccgtgctggcaggttggtcagccagcgtggtcttagccaaatctgctcggcgatgaagggccttgatccgagcaatcagtgtaatcggtgaaaacggcttggtgacataatcatcagcgcccatctctaagccgagtacctggtcactttccgaatcacgggccgtcaacataataattggtacagttggggaagccttgcgaatatccgcactaacttgcatgccatccttgcctggcaagttcaagtcgagcgtcaccatatcccagccatcgacatcttcattgaacatttcgacagcttcattgccatcataagcaaaatgggcatcccacttttccttcttaaaaaacatggccatcatttcagagaccgatttattatcttcaatcattaataatttcatagtgcaacgtcctccaagttaattacgattgctaactttgttgattaatcatcatttattaacctatctattatcataccctacttcgcgctaggattcaggattagtataacaacaaattaataacaaagcgtgcacgatttgtgaaataactgtgtcatcccatcattgagggacacttaataatcttggcacatcagtcacacatcataccagagtcatgctcactgacataaaaagcacgattttctgccgttcataccgaccaggaaatcgtgcatcattcagttacatttcacgagttgcgagcgtgaagtcaccatttaagttcaggatgactgccggttcgccccttcacaacgtccactgtgcctaattcttaaaggagtggattggtgccggaatatgacccccacgcttaatgaacgtcgttggttgattggtgttgaccggcataactggtgcttgaccgaacaagcccccaaattcaaccgcatcaccaacacctttgccggtagctggtatgacgcgcaccgccgttgttttgttgttgatcatcccaatcgcagcttcatcggcaatcatcccactgatagtcgcggcactagtatcaccaggtactgcaatcatatccagaccaactgaacacactgctgtcatcgcttcaagtttttcaatattcaaacgaccagcactgaccgcccgaatcatctcagcatcttcagaaaccggaataaaggcacccgacagtccaccgacatgttcgcaggccatcacgccacccttcttcacggcatcattcagtaaggccaacgccgccgttgttcccggcgcaccgacactttccaacccgatttcttccaggatctcagcaaccgaatcgccttcgttaggcgttggtgccagtgatagatcaacaatcccaaatgggacgtgcaaccgttctgacgcgatggacccaacaaattgccccatccgtgtcactttaaacgccgtcttcttaatttgttccgacacaatgtcgatcgactgaccgcgaacttcttctaaggctcgttttacgacaccagggccactgatcccaacgttaataactcgatcagcttcaccaacaccgtgaaaagcgcccgccatgaacggattatcgtcgaccgcattggcaaataccactaaactcatgcaattgaccggatcgtcagccgcaatctgctttataatacgacccatttcaccgaccgcgtccaagttgattccagcccgtgtcgacccgacatttaccgaactgcaaacacggctagttgcagctaacgcggcgggaatcgatgcaatcagtttgcggtccccactctgataccccttctgaaccagggcggagaaaccaccaatgagatcgacacctagcgcttgagctgcccgttccatggttactgcgtacgcgacatagtcttgatcctgactcgcagccgcaatcaatgcaatcggtgttaccgcaattcgcttattgatgataggaataccgtactcttcttgaatttgagcggccactttgaccaggtccttcgcgctagtcgtgatcttatcatagattttttgtcgggcccgctcaccgtcactatcaacacaatcaaagagcgaaatgcccattgtgattgtacgaatatcaagattttcctcggccaccatctgaattgtttctaaaattgaacgactttccatggtagcctcctataacttctgaattgcgtcaaaaaccgcttgccgttgaattcgaatcgttaactctgatgcctcaccgagcgattctaacgccgctttggctgccgcaaaacttaattgctggtcatcccattccgccgatagcatcatggtaaaattatgatccatcaaggtttgcgaaatatcgacaatattgatttttaaacgtgctaactcgttcgctacttttgcgacaattcccacttggtcctgtcccacaacggtaataattgctttcatctttatagcctccgttagacgcatcattattcgcgtttgattgttcatatcatagcatgagttcttctgaaacgcacccgttacttttgatgaagtaacccatgagaataataagagattcctcataaacataggttcccagacgcacctttgctataatgaaaattgcttattattttcagaaaggagtcgtaatttgacacaacaaaatcatttacggggcgtcttactcgctagtagtgcctgtattctgtggggtatctcaggggtggctgcgagtaccctcttcatcaataatccgcatctaaccgcaatgtggctaacgcaggtccgcatgatcagtgcaggcttgattttactcgtctgggggatggtggctggtaaacatccctttaaaatctggcatcaccgccatgccgcttggacagcggtgagttacggtttgctggggctgattccggttcaactttgctatttcgaagcggttcgcgttggtaatgccccgattgccacgattattcaatttcttggcccattcattatcagcatctattacttcttatttaagcacgtgacacccagtcgtatcgaactgattggtatgatcatggcctttatcgggacactattgatcgtgacacacggtcacttaaacagtctggcaatttcacccgtcatcttgttctggggcggcttatccgccatcggggtcgccacgaacaccttgattccgcgaaccattttaccaaagtatggcgcattaaccgtcactggctgggggttactgattgcgggtctgtttctaaccttgttacaacccatgtggcgtgtccacctgacgattacctggccccaattaggcttgttaatcgtcattattctcttaggaacggtggcccccttcctgatgtttgcgcgtagtttaagcgatattctaccgacaacggccagtttgatggacgccttcgagcccttagccgcgacggttttctcgattacttttctaaacgttcaactcactagcttcgattttatcggcggcttactgattatcttggcagtcatggcactttcactgaacacacataaaatgttgcactttttgcggcgccgccgagcacactcttcatcttaaactgctgtaatgattgtcatgaccagtagacagattagttggcagaacagttgagctgtgctaaactaggattgttgaatttggggatgttctggattcgacaggtatagtttgagttcggattgcgcttcgtaggttgcgtctacgtaaaaacgctcagtttaaattataactgcaaaaaataataacaattcttacgctttagctgcctaataagcgcttaacgtagatcctcccaggatcgtccatgttctggatctgggtcctaaatttagtggacttacgctcaaagcttccacctggagttgcgagaagagactaatcaggttagtcattgctgggtgccctgtcatacggcgtttgcaatgatgaaatttaaatagtatgaatatgagcgtagatatccgaggggcaatatgcttggacgcgagttcgactctcgccatctccattattgagtttcaaagtgatgtaataagctccagaacacttgttatatcaatattcattaaagctatcctaacgggatagctttttttgtcctattttgattagcgtgctacttcagtaaaaagcccttttccaaattggaaagggctttttttaccgataatacaaccatggttaacctgatcaaccaaaatctgtccaataattataaacgccacagccaacggtgttaaagtggattgcaaccagtctgttaaaataataagtgctcacggcactaatccagctgcgttagcatgcggccatttagaccgtaccgacccgctggcggttaaacccaacctgtactaagatccgatacaataacggcacaatgatgacacatgccaccgcattaatggtcgctgctaataaactcgtgaaggacccaatcatggcgaccttgagcgttgtccccaccattaaggcttcaatcacgcctgtacaccacgaagtgacgatttttgtgagccctgcgactaacgatacccagtaaagccggccaatacgatcttcacgatagccgattgacttgaaactcaggttgaccatcgcggccagaataattgcttcaataattgttaaccacgaagttgcggcatacccattcagaatatcaaacaagccaagccccactgcaccagccgtagcaccatagccaaaaccaagcaacatcactgcgagcactgtcaaaatattaccaaaatgaataaatggccgcccaacaatcgcgggcaacggaattcgtaatacactgataccaataaaaataatggcggcaaataaccctgccaagacgagcttttttaattgttcagaccttcccattcaattccctccaattttgcacatctatttatcattatattctaatataagtgtgaatcaattgatagtcctagtctatttttttcgtgacggtaactgaataatagtcgctcgtgtgggcgtctcaacacttacttcatacgcaactgctaacaaatcataagcagctcggggcattttgtattgatgacacactaaataataacctagatcaacagcgatttggtgcgcgatagcaatactgtcaccactacgattaagccggcgacgagcccgcgcaactaacctggtcaacacaacatcgcttcgaatctcaattgccatgctggcaagtgctagttgggcacttaatcgttcattcggttgggtcgtacgtgcttttgcctttgccatttttttcaactcctcagtgtaatcataggagtttcgctttggcttcgcaacgaatgacaccctcaaagccgcgtcatcactgagctcgtttaactttcacaaaaaatattattgaatcatttcaattcaaattcagcaacagcgcccacatcactagtccattccatataagtaattttaacttacgatttaatttatatctgccaccgatacttaatcatccgtctcttgattcggtaacccgaatagcaataccccaacaccgagtaagagtacggccacgaacaccataaaaattgccggaatgccaaatccaattgccatcagcgcaccaactaaaaatgggccgatggttgcgccaatgcgaccaattgactgggcaacgcccataccaattccccgtaccgcgggcgcaaattgccccggtgtgaaagcaatcataattccccacgcccctagcgtaaagaacgacaaccatgcaccactaatcagaatcatcgttggattattggccgtcccaaaagctgcggcactgacgaccgtcccaatcagataagttgccaataccgccttacgcttgacgacgccgatcaaccacgcagctagataatagccgggaagttgcgccaagctcatcaacatcgtatagccaaacccatgtactaatgaaaatccgcgcaacaccaaaacgcttggaagccataaaaacataccgtaataggcaaacataatcacaaaccatagaatgctgaggcaaatcgtagctcgtcgatatttagcggaccacacttgccgcaatgcctgtctaaaatcaactttttgtggccgattagcctcctgttctgcaggtaagtgtcggcgtaacagcaacgcatacaaccccattaaggcggtgattaagaccgtcatccgccaaccaatgtgtggcatcactaaaaaggccaataacgatgctgcaatccagccaaacgcccaaaaactatctaccaggactagcatgcgtgagcgctgtgttcccgtataatgatcagcaatcattgtcgcagcaaccggtagttcaccccccagaccaatgccagtcaacaaccgaacgactaagaaccactcgacgttcggggtaatcgtcaataacaaattaccaagcgaaaaaagcagtagcgtcccaataaggaccggcttacgccccaatttatctgctaaatagccgcataccaaggccccaatcatcatgccaaacgtggtgatcgcactgactgctcccaactgtcctgcagttagctgccaactttctttaataaccggcatcacaaatgatagcagggccacgtctaacgcatcaaaaagccaggccgtcccgatgacccataatagcttagcactatttcttttactttcgaccattccaatactctcccaaatttcctaattagccttccactaatttaggtattttttacctttatggtgctataaaagtagcataccgacttggacgtgtcaaatgaactactttagccggtataccttagcggggcgtccagaagagccaggtcgggctgtccccacctctgtaaataaatgaacgtgggttttacgaaagtttgaattgtcgatggttgccactggctgccgccacaaaatcgcatacagctggcgcgcctgtttgagtgtgaactgctcacctaacactaataagatcgtaggagcatagtccaggcgattgcgcacacgttgtagggcgtttcttaagatcaggccatgatcggcggttaacaactgcttggcgattcgttgataaaactcccgctccgtctgcgaatcgggaacaccagcaaatgccaaaccatcagcgaccagatcatcacgatccacccgcggcgtaatggcaaaccacttgacatcgcgcgcaccataccccggaactagttccggcttgactggcaaataaaccatatacgtcaacgccagtgagcgttcacccggcacgcgatcgaccgcggtaaacgtccctaactgttctgtatggaattgggcaagctggacgcccaacttctcacgaactaatcgcaatgcggcttcatccgcactctcatccgttctcaaatacgtcgtcggtaatccccaggtattctcaaaaggagcgtgatcacgctgaataagcaggaccagcagttgcttggtcactgcatcgaaactccagattacgttcgtaatactgattaatggccgataactgacttcatgcgccattcaaatcgtcctcctacaaaaacggccactggcaaatgccgtggccgttgtttattttttaattcattgcttgtagcgcttgaaccgtccacccgttaatggctgacttttcaataattgctttttttatttcccagacatccgctttgatatagcgatgtcgggcggtcattaagggaatatcagtgtagacctcttgaccgcgattaatggtaacgcgcattgaattacatcctttcctaatgctcaggaaatctgtaaataattctaatactcaatactggggcaagtacatgatactaaaaattaatttatccaaaatctgaggtaaatttaatccggcagcgtgaagtccaccgaactaacaattaactttatcatatttttgaagttatcgctaacagaatgctctttctttgacttaatttaaatttagccctaataatgaaggcgtttgcattgtgtaaaaacagattccgatttacactaaaggtaattttataagggaggtttttacatgcgcaattataaatatgccgtatatggcggtatctcagttgtttatttaattaccctatatgcgttgtaccaccttattcgaacggcttatattctattctttctctagcccagaccaacccgctgacttcaggataacgatcatcaaacaagctcatctgacctgactaaggccggatgagcttgtttgattttgattctaattgcgtaacgtgactgactcacagtcccaaaccaactattgattagcagagccccggtcatatcatcgatgccataaaaagcggtcaactgccagtgctaccttagcattttcatgtaactggctgtgctgcgcatgggccccataaaagtctttttcggtgtaatcaacatcccgcccacgcaataaatacttgatggaacgggccgacacgttggtgaccaagctgtccgaatgactaccatcgttcaaggttcccacgatattcaatagttgcacatttttaggaaaattgctccgcttggctgccaataattcataggctgcatgtaaatatttcggttgcccagaagtcagaaacgagttctgattagcaacatcatcttccccgaccaccccatcaaacgggccagcgatcgtcactaacttattgatcttcggaaaagtcgtcgtttgttgcgtcatcagcatattaacgctagcgacacagcccgcagaatgggcgacgatattataatgtttaaacgcgtgctgttgttgaaccgtggtaatcaccttagccagccaagcactctgttggtcatactgggccagattgttcttgaacacgacttgaattatcgggttacgcacccgaccacgccatttacccgtcaacgtcacttgaccactggtactgaccgttgccaccaaaactttgtgagcatgagcagtcttttcagcatgcgcaatcagggtattcgttgatttcgcactcccctgaaacccgtggacgtaaaatgtgggggtctgttgattcacatacggcgatatttttttagtacttgccgcctgttgcgttgcttgtttcttagtggtttgagaaccacaaccggttaagccaacgactaataagactgccaacagccaccatttaatttgtttcactttatccgccccattaatattttgaaatattctactttaattaaatctaagtcaattgaactcacattaccaatttcgtttgacagcgaccaactcatcttgtaaataagtgcttgctaactgcaagtatgtcacgtgtttgccaggcgtgggtgcatgtaatagccagccatcaccggcgtatagggcaacgtggtgtaccgcaccgttcccatgattatgagcaaagaaacacagatccccaagctgggcatttgctaagtcgaccgccactccttgcttgatctgatcctgagcatcgcgcggtaagcaaatacctagactgcgatgcaaggtatagacgaatccagaacaatcgaaaccataagcactgatgccaccccataggtagcgtaaatccaagaattcttcaccgagtcgaacgagtgtcgctcccggtgtcaagcgcgcggttctaaatgcaaactgcgtcgcacgttttgcaattttgcccgttccgagtggggtctggaccgtataataacgatgatctttgctactaataacgggtagttccgttccaaggctaagatttaagaacgtacggccatctaagcgtagtaacggcgtaaaaccacgccgtatcgtaatcatcggcccagtttgaaccggcaatgggacggtcgacaattgcgccgcccatacccatcctggatacccctgtggatgccgggagtcggcctgattaacaacgtaaccataggcccagccattgacaaactgttcgactaaaaagacgtcgttaaataacgcctgcgtcacgatgcgattgtcgcgttccaaagccacagtatcttcatctgataactgcgccaaccatggttgtaagccgacatttgctagtgccggagtatcgatggacgtattgtttggctgccgccacacgttcgcaacggccgcaatgatccgtgttgattgcattctagtcacctcattttttcagtttaccatatctccggaaccacgtctggcttcctggtcaaaccttgaagtgattttaactttaatcgatcgccccacaccgccgtggcacctcggcacgttaagaagctatcctttcagtagaaactttacactaaatattaaaaatcactgtgaaagtatgctatgatactaataattacttaggaggcgttttaacgatggataaaaccgatttgaagattttgaacgccttgcaggccgacgcgcgaatctccttaaaagcgctcgccgatcaatgcttcatttcttcgcccgcaatttccgctcgcatcactcgtctgaaaaagagtggcatcattcgtgactatcaagcaaatcttaactttgaaaagctcaattaccacataaaagcctatattcaactccaacttgaaccaacgcaaaaggagcgcttttacccatttgttgccggcattcctaatattctggaatgtgactgtgtcacgggtgaatactctcaaattttgaaagtgattttcgaatcaacgcaggcattagacgagtttgtcaaccaattacaaacatttggaaaaacgagtactcagatcgtcttttcaacaagtgtccctaaccgtggcctcacgttgcccgatgatcatgacatgtctaaaattaatcattaatccgcatgcacagggaaactgtagcttaataggcgcaccgagaaaccatgttagtttctcggtgcgcctatttaatgaattccaattgcaatgtcagagatcggtagcccgcttcaaatcaaacccaactatcagttatgggcacctcaggaccaattcaataacctaaaaatcgcttgtggtgtcgtcacttgataatgacgcttgagaacttctaagccaatattacaacctaccaatagactcccacctaaagccacgcccacccataattgtggtcccaaccaatgaatggcaactaaactacacaaaaataacaccgcaccaacaatcattcctagcgtgtaactcacaaaccatcgtctcattgggcacctccacgacacaaactaattacgcgaatcggttcatcacataaattgcaccaagtccaattccccataaaactaacagcggtagtaaaacgagcatgccgaactggtaccaacctaataccatcataaataaaatctcaacactatggccgaacactaataattgaaagtattcacgaaaataccactgcacgccgataccaatcaagaaactaatcaagatcacaccatagaacgttccatgcagcattttacaaactcctttttattgcgtttgctatctaaccttacatggaaagtatgccgtattgaggcctaaatcatcatcatatttatgtaaagactaggttatttttcagtaaagactgtttgatgatttttaaattattgcaaactgctgttaacagttacctgcgtaacgtgttatgattaaaggacaaattaattaaacgcaacaattatgggggcgcactgtgttacatctacttacgctatcgagcttaggccgagatctttttaatatcaaaatgctaattgtcgttctcattacaattggcctgatcaccctaatgaccattctgacctacctcctagagcaacaggtccatcgtcgtcaaaatcgatattggactattgtggcccatggtgccgaggctttaagtgtcctcattagtatgatcctattacgacaaatattcattacgctgaattcaggtagcattatcagttggacctacgcaacggttcaattaacgattcttctgttcagccttaacaccatgcgcaacctggccgttgaaattattaacctgttaatgccattgttcatttatggtcaggccatctggttgggccacagcacgcagtacctgccagtttttctggccatggccattatcttgattagtacagtcgtctatattactcataactatcaagaattacacgctattcaatggaagtatctcctgttccaaatactatatagtggcacttggtggggcgttatttggtcagttcatccgttcaaattgagccatacactcgtcatcattctagcctttgtcctttacatgtggttgattcgtttagcagtcaatcgcgtccaaaagtttttcaatgaagtgctcacctttgatcaacaagtcaattacgatgaattaaccggtattcgtaaccgcgccagctttgacacgcatgcgcgtgaagtgtttgccgcgtatcagcaccatcaaatggggcccgtcactatggtcatgttcgatattgaccactttaaagcctttaacgatcagtacggccatctggctggcgacgccgtactccgacacgtggcgcattttgttgaacttgaacttaatcagcgcagcactcacggtcagatcttccgctatggcggtgaagaattcgtcatcatttttcgtggcatctcagcgcttgaaactggtcaaataatgcgtacgattcagcgtaaactgaaaacagtgccaatcaaatttaacgctcaaacgttgaacgtgaccgtttcaattggtatttcagaattgcaaccaaccgaccagactttcactgattggttcgtccgcgttgacgactacctctatcagtccaagcaggccggtcgcgaccagaccacggttgaaagtcaattactaacggattaataattgttcccaaaaggccgttaatttgtaaattcgttcccgatttacaaattaacggcctttttgggtttagcgattaccgatggggacaatggcgcgctgacggtccaataattactgaatcgccagcagtccattttcaaattaactagtcagctaaaaataattttctcctaatcaggacatccaaaaacagtccatgcttgaatgtctgtccacagacaagcccaagcatggactgctattaaaaaggataagaattagccttgtcgttctttcaaactgagtttctcgacgttcaattccttgtcgacccagccattcacaaaactgctctcatgactaaccaagattagattaccttggaaagcctgcaatgcacgcttgaggccttctttagtttcatcgtccaaatggttcgttggttcgtccataattaagaagttacttggaaccaattcaagcaaggctaatttgaccttagtctgttcgcccccactgagtaagtgcatgggcttcatcgcattcgccgcattaatcccacacttagccaacttagtccgaattgtcttcggtaacatcgtagggtattcattttgaatcgtctgtaacggtgtcaactgtgggttatcccattccaaatcttgattgaaataattgattttagcagatggcgaaaaatctgacttaccacttaacgctggaattacacctaaaattgacttgatcaaagttgatttaccaaccccattaaagcccttaaacgctaatttttcaccgttggtcatcgtaaaagtcacgggttccaacaacggctttccgtacccaacagacagcttcgtcacactcaatgcattttgagaacccgtatcaaggtatggaaaggcaaacttggcgtgttcattttcactcggtggatcaacccgatccaaatgcgatagcatcttttcccgtgacttcgccatcgttgactttgaaccggccttgttcttgcgaatgaacttttcggctttttcaatcacaacttgttgcttttcaaacgccttcagttgggcttccttacgtgcttctttttgccgcatagccgctttaaaatcgccccggtacttaataattttaccgaatgccacgtcacaaatacagtttgtgacctgttgcaagaaatcatagtcatgagagatcaccataacggccccttcaaagccgttcaaataatcttccaaccaactgatatgcgccgtatcgaggtagttcgtcggttcatcaagaataatcacatccgggttttccagcaatagtttagccaagatgatcttcgaccgttgaccaccagacatctcactgatgacgtgatcccgaccgatttcatctaatcctagtccggtaattacccgttccatttctgtctcaacatcataaaaattattggcttccaaggtctcctgaatccgacctgcacgttccaataactggtcatccatcttttcagcataatccgcataaagttgttgcatctgcgcatctaaatcatacaagcgttgaaaagccgttttcaaaaaggcgtatagcgtcatgccggctggaatatcggcgtattgatccagatagccagttcgaacgttgcgctgccacttgatctgaccagataatggtaagatctggccagttaaaatcttaattagggtactcttacccgccccattttgaccaacgatacccatatgatccgctcgttccagcgtaaaattcgcatcgtcatataatttacggtccgcaaagctttgcgataaatccgttacttctagtaaagccatgttgttttcaacctacactttcattttgacccgtattaaaacgggccccgtcatatcacgaggcccgttgcgatagccctgatactaagctagcaccaagtctttatctagttcatattgcatatggaagtacatccgatcaccgataggcttaattcctaccgattcgtaatgataacggtcatagagcttcttagctcctaaattagccatgtcaacgttcaaaccaatccgcttttgaccagcttgtcgcgcgtatcttggcagggcggcgagtaacttcccgccaatcccatgaccctgataattcgggtcgaccgcaatcgaatccaggtaccattcgtgctcataactttcagcttcagcttcaaatgctgaaccaaacgcatcattattcgcagtaactcgtgctaacacgtcgtccaccgcgtcctcatttttgtcaggataaccaaacgctaccccgaccacttgaccatcggcctcggccactaccgtcgttgccttaccagacaaataatcaggtgtccggtaagcggcagtaatggcctgctctaagtcaggttcaggaatatcgtctagttcctcaagttgcatttcatcaaaaatcatattaattagcggtgctatctggcccgcgtcgtcttgatcggctggtcgaattgttatcacgaatagccctccttcttatagtaacacctacattactatgaaaagcaagcattgtcaaaagtcgcgtccggtgtgaacggttacagttgttattttttgagttgcttcccaaatactgtcacatccgtcccattatcaatcgtggtatactgaataacaccgtcttatactcattattattggcatgaatcatgattaaaacgtaccagttagattgctgttcgtcagccgttgcgcgtcctatgccgacctccggggctgggtgacaattgctggaacgcagccgacgtcgatttgagctaacgcataacccgcgtcatctcaaatacgagtcttattctaagccggaagaaagacacttccgactaagaataatttggctactgagcattgtcacccagcccctccagtctcaagcctgtgaggggccacgggttgaagccgagtattgcctggccaacagattaatgtggttttggcatttgtccgtcggcgtagcaagcacaggctttagtggcaccgaacacgttttgggaaccccctcgaatggcagattaacggccacttaacttggtaaaatttgtcgctgactattttgataccggaacctcaaacgaaacgtcagggttccattaaccactttgtcgagacgttcgattattactatgccgcttgaggaatagtgatctcccacaatatcactttcagactgacagttaattaacaagattaccgtttatgaggaacaatgataagtccatcaaaggttgggtacatcaccgtcagccattcgaatactgtcccgactggaaggcgtttcggtcaatgctcagcggtgaaattccacttagcaagcgtcctttgcttggttagcggaagacaagtatttaagacgtgggttgcggcttaaatctgtgtccaccgcgttccagcaattgacggaaatgcctggaagtcggcgtaggacgaaccagcaaagcatgtttacgctaactcgcacgttttccagcgggcctaaagctggctgcttttgaacttacacaactggtacattttaatcatggttcatgccaaatctgatgagtacgacacgtttaataatgaattatttttgaagggatttgagcttgtgaatattcgcgatatcgatcatttgaccctaaccgttactgacattgcacggtcattacggttttaccatgaagtatttgaccttcccattgtgaccttcgatggtgaccgccaagctgtcttagtgggtaaacaaaaaattaactttcagaccactgaccagccacaccaacccattgcggctaagccgacacccggcagtgcagatctttgcttgattgcgaaagataatattgatgatatccagcatcacttaaagagttatttcgtggatgtgattgccgggccggttgaaagaactggtgcccacggaaagttgacgtcactgtatgttcgtgatcctgataacaacttgattgaaattagtaactatcattaaaaaacaccacaaagactaatcatcgaagacgcccagggcaactgttcagtaacttgcgaacaactgccctgggcgttttttgatcgttatctggatattttagtcaatcgttgatcaatctgcgctgctagctgtgtaattccagcggctgtcagtcccgtttcttctggataaatcagaactcgcgcactagcttgtaagtccaacacggctgccactggtcgactgacgaccagcaattggtggtcggtcaccggtaagtcgtccgcggttgcaaccctgaccttaagcatcgattgagttagcgcctgcattagtcgcttgactagtcgtgcatcaagtgccgcgtcaatcaccatgcttcctgaaactgaattctgtaaaatccccgttggcgttgagttcaatactaatacttcgtcaatcatgttaccgcccccctataatgccaatagtatatcgtgggagtcagtgggaagcaatcaaacgcactgtccccgcatcaagttgttcatttgctgtcatccgttgcctcgataaccaatgcgacaaaaaaagttccgcctaaatcgaaaagatttagacgaaactttttcaataaacccaacgtcgacagcgcgtaacttattcagctgcgccaatcaaatcaccgctagtcacatgaccagttggattaagggttagtttgttaacgtgatccatattggtgataacgaccatcatggttgtcgctttaccggctgacttgatagcagccaagtcaaccgtcgctaccgcagtaccggccgcaatttcatcacccgttgccacgtgtaacttgaacggcgtaccattcatttccacggtattgatccccatgtgtaataagacttctaaaccactcgtcgtcttcaaaccgatagcgtgtttggtcggaaagacacttgtcactgtcccactaaccggagcaacgacttcaccatcttcgggttcaacagcgtaaccatcacctaagagtttaccagcaaacgtctcatccgcaaccgtactaatcggcattaattgtcccgttgccggtgcccgcaaaatcgttgtcaccggcgcttccgttacagtagcagtttgcggttcaaccggggcctttgattcagcatcagatgccggggtcgtcgccacctgaccagaaaataatttttgtaaagcctccgcgacgaactggacttccgtgccgatcacaatgtgaatgttatgaacatccagtacgttcaaaccaggcacgccagcagccattacggccggctgatcgactttttccgtatccttaagttgtaaccgcagccgcgtcgtacaattgttgatcacactaatattgtcatgaccaccaatagctgcataaatttgctttgcttggcgcatatacttatcatccgttgctgcaacggccaccgctggactagcaggtgcacccaccccatcgacatctgcagacacaacttcacgaccaggcgtcttcaaattaaaccgtttgattgcaaagtcaaaaccaaagtaataaatgacggccatcaccagcccttgaaccagtaacatatagggttggttggctaacggcatccgaaaactcaataaataatcgactaacccgccactaaacgaaaagctggcggtccagtgcattaacgcggcgaatcctaatgatagtcccataaaaacggcatgtaataagtagagcggccatgccacgaacatgaatgaaaattcaagcggttcggtcacccccgtaaagaacgacgcaaacgcaccagctaacatcaatgaacccacttctttttttcgttccggtcgtgcattacgataaattgcatacgcaccagctggcaagccaaacatcataattgggaagaatccagcttcatacatccctgtgattcctttaacaccatggctggcccagaaattgccaatatcattgatccccgcaacgttataccagaatacggaatttaaggcgtggtgcaaaccagtcggaatcaataaacgattgaaaaagccatatagaccagcccccacgaaacctaattttgaaattcccgttgcaaagaggacgatggcatcgtagacaaacggccaaacaaggtacaataccgccgtcacaatcagcatcacaaaagcagccataattggcactaggcgtttaccactaaagaatgagagcgccattggtaattttacttcgtggaaccgattatagagcgcagccgcaatcagtccagcactgattccaatcagcacattgttatctaacgcgctaaatgctggattgatctgactcactttaacattcagcatcgtcgctaatgtcgctggttttaacaccatcaccggaacttcaaacgcgatcaaaccagcaatagctgccgcgccgtccttattgactgacatcccgatagctaagccgactgcaaacagcaaggctaagttattcaggacaacgttaccaccctgaatcaagtaatttgcaaacagccactgttttggcaggtaattcccaatcccaaccaaaatcgctgctgcgggcaacgttgcaatcggtagcatcaatgactgaccgattttctgaaaatatgtcttcataccaatttctcctcattctctttttaatcacgttataaatcctatcacaacatgttttcattgcaagtttacaaggtcacctaagtgtatagaccaatgttaaagaaaccgatttcaaccttactaaattaagtttttccgcccacaaaaaaagttctgaaaatactcagaactttttcattaataatcttatttttcagcaacggggatttccgggtgccggtattgccgcatcatttctgctaaatggacttcgtgagtcacaaactcatgcacgcgacaaacgtagtcatgttcccgcccaatcttagcaatatagccattaatataatcaacttcggttggccgtccctttgagaagtcttgatacattgatggataatggtacttataggctcgactgaccgtttcaaccgagtcgatttcttcttgccgcgtctcaatgagtttgatgcctgccctttcgcaagcatcataggcttcgttgaacatttgagtcgccatatccttgacgcccggatattcgatgaattggcccatctgaatctcgaacatcgtgcacaaactattggtgaccgcgttaaacacaactttggacatgcacatgcccataaaattatcagaccaaatcggatttaaatcagccgccttaaaatcggccatcacttgcttggtagtcgtatcaatatgacctgcatacttactcatatgcatcgcctcactacccttaggccccataaaatcaaccgtacccggaccattcaagaccgttgcaatcatcgccgtaccaccaataatgtgattttctgggaaatattgtgcaatcttttcaaagtgccccatcccgttcattgcggcgaaaacgtactggtcctcatgaaataacgacgcatcgcgcttgagctcatcggctaactgcatttgcttcttaaaaacaatccaaacatctggatgaccctgatattcttcaggataataaatattgattggaacgacatggtgattttgatgatcacgcgccacatcaacgccgccctgctcacggacctttgcgacgtttggttcccacgtgtcgataaaatcaacgtcaacaccggcgttttcttgtaacattacaccataccgatatcccattgcgcctgcgccaataatgccatatttcataagtaaaaccatcctttcgtcttgcccactatgtgtatatgttccccgctcgcttcagtgcttttccaataaacgggcccgtgcttacgatctactatgtgctgtcacgtgatgtcgaacaactatgtgtttacgatgattaaccgcgatgcgcgacctaaataatgactactatgtgttaactaaaaaataatgctatgtgtcacttgacgaaaaagcgccctttgaataatcgatcaaattatccaaagggcgcttacgcgcggtaccaccttattgctaaccgaactcacatccggctactcatcgcgttcacaacaactaaacgcgtgcacaataatgggtgctaccagtgaatctcgtaaaattcacgccaatcctttaacttttactcacttgtcatcacaccttcacagcaacggcgctttctgagcatcacaagtcagttactccttaaagcattatagcttttcatcaagttttaatgttataaccataatatcattttagtaaaatgtcaaccttcgatgcaaaacttttttaaaacccagctgtctgtatacgacagtatcatcagcaaaccgcacacgggcaaccccaacggcctattgtttttgctcctgattgagggtcgtcaacaatggcttccaatctaatgaccagatcattccgagcgcatggtctccagtcaagacgcctaaaactggaccgataaccccagtcttgacccggactgctggaaactgataacgtagttcgctcgcccagtcttcggcaatccgcgcgtcattagcgctgatgacgtccagccgaactggtaattgactgttcatcacaaactgactaaattcatcttgaacagcctgttgtgcatttttgagcgtccgttccttacctaaaagttgaatcttcccatgcccattgaacgtaataatcggcttattgcgcaacaccatcgttccggccaaactactattattataaatccggccatttttaactaggtggcgcatcgagttaacgattaagaccgtcgtcgtagccgcccgcaagcgcgtcagttgcgcaataatttcatctaaggtgtagtctgccaatgccatggccgcagccagcttcaccatgttcgccgtccccgcgcaagcagttcgtgaatcaaacacccgcacgtcaataccgtcaactgacggcgcataggtcttcaaattattgatccagccactgataccactactcaacccaataactagaatttggtcatagcccgccgcttgcagctgatcaaaaacgacttgcatctctggcattgaaatttgagaaatcgttggaatttctttttcaacttttagtaatcggtaaaattgatccgtcgtgatatctacgttctcgtggtaaacatgattaccgaacataatcgggtcgttcaccaccgtaatttggtagtctttcaccgcctgcgcttttaaattagcagaactttcggtcaccaccgcaattttcataatttcactcctcatcgtgtcagtcaaccaactgccacgtctcgctaactcatttcaattagctcatccacttagccatgggtatcccatgggaacttagcatcaaaaaaagacgctcagatacagtatactgtacctgagcgttctttttcaaattgcaacatttatgggagatgttattgaattttcggtcacttgcttccagtccgttgtaccggcaattggtatcaaagtcagtggcaagttcgcacgcagctttttgcgtttcaccgcacttaatccagtaatctgataacaatcatcggcaatcgtttttactgagaaatcagcttcattagcgtaatatttcacggcttctggtgcgaccggaccaatgcctaagtatgtttgtggtaactggtcaaatcgagtgaccgttaacgagacacttcttttctggttacgaatcattcgataaccattgataaggtgcttggccgctactaagacgtcatttagaacactattagccgtcgccgtacttcccgcacccggtccggtatacaagctggtaccaatggcttcactttgaacagctaccgcgttttggaccccattgatctgactcaagggttgatcaaccggcacggccactggcgccacacgacaatacaaaccagatccgtgtcgctgaatctgcgcgagcaatttaatctgccagccattttcagctgctaatcgacaaaccgaagcgcttaaatgcgtgattcccgtgggtgcaatctgcggcaggctcaactcttgcccaaaagcaaagcgactgaggatcatcaatttgtatgccgcatcaatgcccgcaacatcattagtcggatcagcttcggcgtacccggctgcttgtgcagtagctaaagcttgttcgtacgattgcccggttgccattgcacttagcatataattagccgtcccgttgatgattccgctgaccgcctgcacattgtccgtcacgtaactatctgttaatgtccgcaagatcggaatcccccccgcaacactagcctcgtaaaataaatcacagccctgttttttggctaacgcagccaattcaggtcccgccgttgcaattaagtctttattagcggtcacgacagccttaccctgattaagtgctgccacaatggcctttttagcagttgcgaccgtccccatgacttcaatgactagttggatttttcggtcacaaacaacgttcgttaatgaatcggtcaagcgcgtcccaatcggtaactgaacagtccgaggcgcgttcaaatgattaacggcaactgctgctaggtgcaaccgaataccctgcgtttgttcaattttggcagccgagcgggtcaaccgttcaaccaccccactacccacagttcctaaccctaacatgcccacttcaattgtcgttgtcattgtcgcaccctccgtttcgcatactttcaatcatcgaccattccgacctattaaacctgtgccaatgcttgatccaaatcagcaattaaatcatcggcattttcgacacctactgaaattcgaatcaagtcaggcgttacaccagctgctaacaattcctgttcatttaattgcgcatgcgtggtggaagcgggatggataattaatgatttagcatcagcgacgtttgctaacaatgaaaagagttgtagatgttcaattaatgccttaccagcagcctcgccaccagtcaagcccagggtgaagatcgaaccaaccccattcgggaagtacttagttgctaagtcatggtacgggctatcttccagttctggataattgatccaggcaacttttggatgtgcttttaagaaggcaacaatcttgcgtgtattggtcacgtgtcgttctactcgcaatgacaaggattctagaccttgcaacaacaagaaggaattaaagggactgatagttgcaccggtatctcgcagcgtttccgcccggaccttagtcgtaaaggctgccccgcccaaatcggcaaaaacgaggccgttatattgcggatctggcgttgtgaaatctggatacttgccactcgcacgccagtcaaattggccgccttcaacaataacgccacccatggtcgtcccgtgaccaccgataaacttagttgctgaatgtacgaccacgtcggccccatgttcaagtggccgaactaggtatggtgtcccaaaggtattatcaacaataaaaataatgccatgatcatgagcgatttttccaatggattcaaaatcaactaagttaatgccaggattaccgatactttcaacgtacaaggccttagtatgatcgttaattgccgtctcaaaatttgccggttcgtcaggatcaacaaagtgcgttgtgatgcccaacttctttaacgtcacgctaaacaggtcataggtcccaccatacaaggtgttggccgccacaatttcatccccctgttgcgcaatgtttaaaattgccgcggttatcgcagcagaacccgttgcgagcgttaccccagccgtcccgtgctccaaggcggccactcgtttgtcgaccacgtccgtcgttgggttcgtcagtcgtgtataaatattgccggcatcagtcagggcaaagcgacccgcggcttgcttggcatccttaaagacgtatgaagtcgtttgatagattggcacggcccgtgcgcccgtttcatcaaccgtctggcccgcatggacttgtaacgtttcaaagtgataattttcaggattcgttgttgtcataattaataacctactttcgttaaactcaaagttgctaaccagttttgatacagttgattgcttgaagtttgccaactgtaatcaactgttgttaattgttcagtagcaaagtaatgttcaggtaactgaatcggcaagtgcttacgtcggtcgcgcaaatattcatcggcaagcgtgcggcgctcgtattcaggatgaccggtcacatagaccgcgtgcagcttgggggcagataagacgagcggtcccaccttcggattgtcagcgacaacctgcaatccagcgggtaagcgttccggcatcactagtgctgtatgccgtgactgtggcatttttagcaaacctcctgcattcagtccactaatcagcggtgacttaacatcagtactagtcgcactataaataccgaatatcttgtgagcaacggcacgctttgcgattccaaactgtgcgtatagccctgcttgtgctgcccagcattcaaataaagtctggctaacgtgctgtcgtgaccaatcaatgattgttaacaattcgttccagtaatcgactgcttcaaacggtaacgtctcaactggtgcgccggtgacgatcaagccatcaaaatactgatcttgaatatcagccaacgtcacgtaatgtgccgcgaccactgcttgtggcaggctcttgaaatggtgactcgcgggatacataaacgtcacagccacatctgtgttaccggctgcaaaacgctttaggaactgccgctccgtcgttaccttagtcggcatcaagtttaaaattaaaatctgttgtgcctgatgactttcttgacacgttgcgttcgcccattctccacgggccgctaataatccattatttgctgtgactgtcatctaaccgctccctctcacctgtattgaaacaaaaaaagctcccatccattagtctctaatatgttagaaactaacagacgaaagctttcgcgttaccaccgttgttcgctgccatctcacgatcacaacctcgacgagtaccctgaaaaatctaggaaaccccgcaatatatcggttgccaccgcatgcgtagccactacgacccgcatcatgactccaagctcatcttcaccgcactcctgaatacttctctcaccattacgaagctctctgcaaatcagtgatgcgattactcttctcttcaacgtcttaatctgtttttaatttaaaactaatttaacaccacctttattcattgtcaactcattttattgttttttcgttatgttttacttgaatgcttattcaaaacttgctgaataactaaaatcaaaagcagccagcttaggcccgctggaaaacgtgcgagttagcgtaaacatgctttgctggttcgtcctaagccaacttacaggcatttctgccaattgccggaacgtcttccagtcgggatagtattcgaatggcggacaaagatgtactcaacttttgatgaattcgtcgttgctttttataaacagttattttgtcaatcaactgtcagactgaaagtgatattgagatagctcactaatcctgaatcggtgtagtaagatttaatctctcaacagaatgctttaatgaacctaacgctttgtttaaagtgccagtatcaaaataggcaccgataagttgcgctaagctcggtggtcgttcatcagccattcgagcggtttcccgaaacgtgttcggtaccactaaattctgtgcttgctacgccaacagactaatgtcaaaaccgtattaatccgttactagacaatgttcggcttcaaccgtggcccctcacaggcttgagaccaggcgggttttgctcgggcttaaatcgacgtcggctgcgttccagccattggcaccccgccccggaggtcggactaaaacgaacaaatgccgacgaccaagcatccgcatctcacaagattttcaccacaaattttaatatttggtgaaatttatccttgacacttttttcgactttgcctatactgaactcattcaataacgaaagcgaggaaccaagcatgtcaaagtcagttactaacttgaacagttcatggcaaagccggccgttcagattgtagtgccgtccacacggatacaatctggcaaacagtttgtatctgtgccggctcactttgatattcaaagaagtctgcatgggttttaacacagcaggcttcggttccgtaaagggcaaaccagagcttactggtttgcccttttttattggctttgaacttgcccgagcttaagaaattttttgaggtgattagattgaaacgtatgattgcattcattagtgccttaatcgtctttctgggagtggcctttgtcatgacaggcaaaaccaccgccacgaagacgaccagtacaaagaaagtgccgatggtcggcattcttcaactccagacccaccccgcactcgacgcgattcatcgtggcgtggtcgctggtctaaaggaatatggttatgtcgatggcaagacggtcaaaatcgactatcaaaatgcccagggcgatcaaagtaacttgaaaaccatgagccaaaaattcatgaacgaaaacgccgcgttaacagtcggaattgccacccccgccgcgcaggccctcgcttctgcggctaacaagcaaacccctgttatgttagcaggtattactgatccatcgggtagcggcctaattaaaagcgaccaacatcccggtgccaatattacggggacttctggtgaatctccattgaaatcccacttagacttgttgcggaagctcgttcccagcgctaaaacaatcggaattatttacaccacttcagatcatggtggtgaatataacgccaaaaagtttgcacggatttgtaaacaagaaggtgtgaaatacaagttatatactatctctaacaccaacgatatgcagcaagtggctgaaaccatggccgccaatgtcgacgccgtttatgcgccgcaagataatggcgtcgcaagtgccatgaaaacgctagtctccgttacaaataaggctaaggtaccagtcattccagccgttgatacgatggttaaagcgggcgggctcgcaaccttatccgttgaccagtatcaacttggtaaactaactggtgaaatggcagcccaagttttaaagggcaaagcaactagcgactacccaatcaaagtcatcactaagggtaagatgaccatcaatttaagtgaagctaaaaagctcggcatcaagttcccagcaagtgtccttaaagaagccaaagcgaaaggggttatttacaaatgagtatgatcgtatcgagtatcggccaaggcctcttgtgggcaaccttaggcgtcgcattatttttgacatttcgaattcttgattttcctgatatgaccgtcgaagggacgtttccactcggtgcggccactgctgtcatggcgattagccatggaatgggccccgttaccgcttccctgttagccttcgttgcgggcgcgattaccggcctggtcaccggcctactttataccaagggtaaagtgcccattctcttagccgggattctagtgatgaccgcgtgcttatcaatcaatttgcgcattatgggcggcagttccaacgtttcattgctaggcaaacaaactattttttctaatcactttttggaatcactgcctaaatattttgacagcgtctttgttggcctagtagtgatcagtatcattaccgtgcttctaattgtcttcttgcaaactaacctcggccaagccttcattgtcactggtgacaatcgtgaaatggcacgttcaattggtattaacaccgataacatgaccatcatgggattgatggtctctaacggtatcattggcctgggcggcgcattaattgcgcaaaataacggttatgccgatgtcagcatgggaatcggaatcatcgtaattgcgctagcctcgatcatcatcggtgaagttgtctttggtgaattaacgttgaatcaacgactcgttgcggttaccctcggcagtattttgtatcagttcgtgcgcctgttagtcctccaactgggcttcaacaccaacgacatgaacctgctatccgcattaattctggcaatctgcttaatgttaccgcaattcagtaaagttctacatcttaatcacgttttaaagaagggagtggcccgttatgacgaacagtagtgccccattattatcattaaaaaatatcgtgaccaaagttaattcgggaaccccgaatgaggtcaaaattttgcggggcctgaacttagacgtctatgatggtgattttattaccgtacttggttcaaatggtgctggtaagtcgaccctcttcaacacgatcagtggcgagttgccggttgatagtggcaccatccagttacgtgaccaggacatcacccgactatccgttgaaaagcggaccgctttcctggcgcgcgttttccaagaccccaagatgggcaccgcaccccggatgaccgttgccgaaaacttactgcttgccagccaacgtggtaagcgacgtacgttaaaattacgccaattgaaaaagcacctgccccactttcaagccttaacggaaacgatggatggcaacggtctttcagctcggctcaacacggcaacagaaaatttatctggggggcagcgccaggctctgagctttttaatggctaccgagcagcgccctgatctcttgttactagatgaacacacagccgcactcgatcctaagaccagcgctcaactaatgacacaaacgaatcaacgggtcacggaggaaaagttaacgtgtctgatgatcacccaccatttagacgatgcgcttcgctatggtaatcgcctgattgtccttgatcagggccagattaagtatgatgttcgtgatgaggaaaaagcccaattgaccaaagaaaagttgctaagtttcttcgatattattgaataatcattaagtccatccctattaatactgacacccagtcatcaattttttgatgattgggtgttttttgcagataattgtaaccgttttagttgtgaacaatttattttagtgctatattctaactagaatatttctaaactaaatggtgtcgacgggcacagctatttttcactgataatttagaataattacaaactgcccttgccgacaaacttagttcgtgttatattctatttagaacagttctaaactaaaatttggaggctttacaattatgaaagttattgtcgttggttcttctcatggtggttatgaaacggttcgcggtattttagccgctcaaccagatactgaaattcaatggtatgaaaaaggtgattttctgtcattcctctcatgtgggatgcaattatacctcgaaggtgccgttaaagacgttaactccgtcagctatgccactcctgctggcatgcaagcccaaggcgtccacgtttttgtaaatagtgaaattagtaaggtcgaccctgctagtcacagtgtgcacgtcattgaccacgccactggtaacgaacgtgatgaaacttatgacaaactagtcctaagtgtcggcgcggtaccatttgacctaccagtacccggccatgacttagccaacatctacgcaatgcgtggacgcgactgggccatcaaattaaaggccaagaccgttgaccctagcgttaagaatgtggttgtcattggctccggttatattgggattgaggcggctgaagtctttgccaaagctggcatgcacgtcacggttatcgacctattaccacgtttacttagtctttaccttgatcaagaattcacggatatcttgactaagacgatggccgatcacggcatctatgctgcagttggccaaggtattaaagcgtatgaaggtgttgacggccacgtcaccaaagtagtgaccgatcaaggcgaatatccagctgacctggtcgtaactgccgccgggattcggccagcaactggtttcttgaaaggcgttgtcgacttagatgatcacggtttgatcaagatcaacgaccacctccaaacgagtgacactgacatttacgccgtcggggacgcgaccttagtcccatttgccccaactggcaaggataaccgcattgcgttagccactaacgctcgtcggcaaggtcggattgccgctaagaacttacttggcgaaaacgtaccaatgcctgctgtttctggttcatccgcactttccgtctttgactaccactttgcttccactggtgttaaagaaggcacggctgacaagctgggcgttaagacggcatccgtgttagtcaccgataccattcggcctaaatttgtctctgaagatgctggcaacaccaaagtttggttcaaactaacctttgacccaactgatggtcgcgtgcttggtgcgcaaatcatgtcgaagtacgatgttactgctaacatcaacgccatctcagtggctattcaagctaaactgactgttgctgacttagcttacacggacttcttcttccaaccaggctttgaccgtccttggaatatcatcaacgtcgctgcccaaaaagcagccgcaaccttaaactaaatcaattaggccttaattaagccatgaaacatcaaacggatccctcagccacacatcgctgaagaatccgttttttaatgcatcaaaatgctagtcatcaagattgacagtataccaagtttattttcagatatcgtttcataaaataccatgctagacgttgtactagttattacttagcatgaatcgtgattaaaacgtgccagttatgtcagttcaaaagcagccagcttaggcctgctggaaaaagttcgagttagcgtaaaattacttagttggcgcgtcctacgccgacttccaggtatttcttccaattgctggaacgcggtggacacagatttaagccgcagaccacgtcttaaatactggtcttccacgctttaatgccatattggtgaaacgtgctcgggtcagactgagacttccggttagctacgctatgacgtcaagcggaaattcaccgcttaacgccctagctaggctaatcctcagtctcacccgtctgaacctcacactcttggcagtgctgagcattggccgaaacgccttccagtcgggacagtgttcgaatggcggacatggatgtacccaaccattgatggacttgtcattgctttttataaacgataactttgtcaatcaactgtcagacagaaaatgatattgtgatagtttactattcccaaatcaccatagtaataattaaacgtctcgacaaagtggttaacgccaccctaacgttatgtttaaagttccagtaaaaaatatagtcagcgactaattgtaccaagttaagtggctgttcatttgccatttgagcggcttcccgactggaggggctgggtgacaatgctcagtagccaaattattcttagctggaagtgtttttcttccggctttgaataagactcgtatttgagatgacgcgggttatgcgttagctcaaatcgacgtcggctgcgttccagcaattgtcacccagccccggaggtcggcataggacgcgcaccggctgacgaacagtaatttaactggcatgttttaatcacgattcatgacaaattaactcgcataatgcgtatcatgttaataaaagacggggattcagaaagattaaactcgctgaatccccgccttgataactattatttcaataaatatatgatgtttgagcgactttcatcaagtcagccacgcgctaataaatattaatcaatccctgagttccttgatcacccaagcctttgacatcgaccattacttcataaagtcgtttagcctgcgccgtcgcaaccagattaagtcccatcgcatccgcctcactcaaagcaatccgcaaatctttaagaaaatggcgggcaaaaaagccgggcgtgtaatcgtccttcagaatccggggcacgtaattatccatgctccagttgtcagcaccaccgctagataacgttgccaagactttttccggatcaagaccggctgccttggtatacaataacatttcagttaacccagtcatcgtccctgcaatcatgatctgattggccatcttggcatgttgaccagtaccagcatccccaaaatgattgaccttgtgaccaagcacattaaataatggtaacatcgcctcgtacgtatcggcatcgccaccgaccatcaccgtcaaagtggcatttttggcgccaatatcaccgccggacacgggcgcatccaaagcgtgcatgtcatgttcacgcgcgtacgtcgcaattttaacggctaacttgggttggctcgtcgtcatgtcaattaccgtttttccagcggccaatccactgaaaatcccgtgatcaccaaaataaacttgttcgacgtcccgtgggaacccaaccatggtgaaaatcacgtcactcgtttctgccacggcagccggtgtatcagcccaagtggcccccgccgcaactagcgcatccgccttactttttgttcgattataaaccgtcacgtcatagccggccgtcatcaggttacggacaatcgctgcccccatgacgccggtaccaatccaacctaatttcatcatttacgcacctttccttccacgcactgttcattgcggcgccgacgccaaaaatgaatcagcaacgtaataataaatgctactaatacgataccaccaaaagccgttgcgggaatatcccaaccaatggcaggaattgaaataaataatttgatggcaatcaagacaatcaagcaatacgccatggtttccaactcgggaatcttgcgcattaagcgcataatgacctcggcaatgccccgcatgcaggcaatcccaatcatcccaccaatcaaaacaatcaccggattatccgaaattgccaatgacgccaatacagaatcaattgagaaaatgatatccatcatttcaatctgaatgacgaccgaccagaagttgcttagtccgaagaagcgtcgttgttgcttgggtttctgtgccaccttggccccatttttcggctgactaaagtatcgatacaccaagtacccaaggtaagccgcacctaacactttgatctcccaaaaactgatcaaatacgtgccaatcccaatgattaaaaaccgaaagatataggccccccacaagccatagaataacgatttttcccgctcttgtaaattatctaaactctgggtctgagcagctaagacaacggcattatcaactgatagtaaacactcaataattgctaacgataaaatgattaaccagtcattagcagatgtgatgacgttaccccagttagtcgcactgaagaagggtccatacaactgttcgattaaatgtaacaaacggcatcctctttctcttaatattagtttgttaatctaagtatacctgtaaaaataattggtgccgcttacgcggactaattttcaaaaataaaccttattttcgtcgtatttacgactcatcatgtcaatgagtgaaataagtacccaaaaagctagctgattgcgacctttcttattctaattgtcgaataactttggctggtaccccggccaccaacgtattatcaggcatgtcatgagtaacgactgctccagccgcaatcacaacattattaccgatcgtcacgccgggcgtaatcaccgctctccctccaatccaaacatcatgaccaatcgtgactggatgaccctgggccaagttagcgcgtcgaccactagccgtcaacgggtgattaaccgtataaatatcaacattggggccaatcatcacgttatcccctatatgaactggcgcgatatccaaaatagttaagttataattactaagaaaattatcaccaacatgaatattacgaccattatcacaattaaagtctgcttgaacggaaagattgcgaccgtaactaccaagaatctcttgaatcttggcagtttgcgcatctggatttgttgcatcgatctgattgaactcttggcataacttggcagcccgcgctttttgagcggccacctcagcagctttaaattgataccattccccggctgctaatttatttaattctgacattgttgtccctcctatattttatcaccctaattttactgcttagagtggcgtcgaagtcaacacttgagttaatggtttagcaggtgttattgacaactatcctttcggaccagctgcctcgaatttgttcagcagttagggcaacaaaaaaagaaaccgattgctcaggtttctttgcgccaattctaggccttaaaatcacgaattaattgttggagttgctgattatcgttagccgttccgaccgttagtcgtaaccaccctggccgtaagccagtgcgaatcagatacccatggtgcactaaatagtcagccagttgcgtggcactcggatacttaaagaaaatgaagttcgcgccagattgatcgtaagtgacaccctgatcatcaaagaatgccatccacttagcacgttccgtcgcatttttttggaccgtttgtttcacaaaattaggatcatcgattgccgccagggctgccacttgagccaaggaattcacattgtatggaagccgaatagtttgcatcgttgcggcatatttggtattaaaaacggcgtacccgattcgaaagttagctaacccatatgctttggagaatgtccgcatgaccactacattcgggtacttggctggtaactgcatggccgttacttgagccgcgcccggtgtaaaatcaatgtaggcttcatcaatcaggaccatcgtctccgggggtacttgctggacgaacgcttcaattaccgctaatgattccacggtgcccgtcggattgttcggattgcacagccaaaccatcttcacgtggggcgtaatggccttcattaagccttcgaagttcacatggtcattaggcaacgttggcacactgattaattgccccccctcgatctcagcatgtagtccatattctgaaaacgtcggtgcggacactagcacctggtcgttggtggctaaaaacgtccgtgataacatcacgatcatctcatcaagacctacactaaaaacgatgctattcgggtcgattccctgttgctgggccactgcttgtcgtaactcctgtgcgtcggcatcgggataacgattactctgggtgaagtcccaattcttcacagcgatcgccacttttggcgaggtgccatacgggttctcgttagctgataaccggactaattctgtcaatcctaactcagcttggagggtcgccaacggcttttcgggcacatagggttctaactgttcaatactagctttcattcggctacctcctataggttcttaatttcgggccgatccttatagtcactcatcttaccttcacgtttagccaattctttcttaatctggtcaaaactaacaccacgttcgaccaataacactaaaacgtgatacaacaagtcagctgtctcataggttaattcgtcgtcaccgggatttttggccgccacgataacttcggttgattcctcaccaaccttttttaaaatcttatccagtcccttagtaaataaataatctgtgtaggatcccttcttaggcgttgccttccgttgtttgatcagttcgtataattcttccatattttgcatattcgacaccactttcttctataatatattcatcaatttaatacgggttaaaaacaatcctgcttatcgaccgttgggaccgcattttccaaccaatcagccatctaactcccaactcatgcggctatcgtcatcaatccttaggcgcccggttctagttcaaccgggttaaagaaacaactcgtatgtcccgtatgacaagcaggaccatgcggatgaactgcgaccaatagcgtatcttgatcgcaatccaacgtcatactaacgacatcttgtaaattgccgctcgtagcgcctttgtgccaaagttcttgccgagaccgtgaccaaaaccacgtctggcccgacgccaatgtccgttgatagctttccgcgttcatccacgcgaccattaagacatccttcgtatccgcgtcggtgacgaccgttgtcagtaagccgtcacccttttcaaagtctggtttcatcttacgaccactccttgttttcttaatgtcgctttgacatctgcaatcgttaactcgccaaagtgaaagacggaagccgccaatgcaccatcaaccggggttgtgctaaaaacatccacaaagtcttgtaagttacccgcaccgccgctggcaatgattggcacattgaccgttgctcccagggcctgatataacttggtatcaaaccccgccttagtgccatcgcgatccatgctagtgaccaataactcgccagcccctaaggcgaccgcttgcttggcccacgccactgcatcgaggtcggtcgcttgctgacccccatgtgtatagacacgatattgaccagctgccgcatcccacgccgcgtcaatcgcaacaacaatgcactggttaccaaatttttcagcaccggcacgaatcagttcagggttggcaactgcagccgaattaatagccgtcttatcagcacccgcacgtaagattcgttgcatatcagcaacgcttgtaattccgccaccaatcgtcagtggcatgaagacctgagctgagacttgttcgaccatggcggccatcgtctcgcggtgctcattggtggctgcaatatctaaaaagacaagttcatccgcgccctgttgctgataggcagctgcaatcgccaccggatctccgacatccgtcaagttgacgaaattaacgcccttcttgacccgaccatccgccacatccaagcacggaataatccgctttgctaacattcagtcacccccgctaattcggccagtgtcacaccgccttcagctaacgccttgccaataataacatccttgaacccactggcttgtaacacttgaacatcggtcaaattccgaacgccaccgctggcaatcaggttggccgtgggcacctgtgcttgtagttcttggtataacgcaaggttagggccttgcatcgtgccatcacgggcgacatcggtcacgataaagtgcttggcaccactcgtagtcattgtcttcattaatgtactcatcttggtctgtgactgctccaaccagcctttaattgccacataaccattggttccgtctaacccaatcacaattcgctcaccaccaaactcacttaacagtcgtttgaccagtcgtggatcagtcaacgcaactgaccccaagattaagcgatcgattcctaattcgagataacgagtcgccagctcgtaggttcgaatacctccaccgagctcgatcgtcccggtaaatgcttgccggatcgccgtgattgtcgcgaagttttctgggcgccctgacttggcaccgtccaaatcgaccatgtgtaattgctgcaagcccgctgcgttaatttgttgggcttgaacgacaggatcaggattaatcaatgtcgcctgtttaaaatcaccttggtagagccggacactctgaccggctcgtaaatcaattgctggaaaaatcatttgcactcaccatttccttaaaagctgctagttgttgtaatccgactcgaccactcttctccgggtgaaactgcatcccaatcacattttgatgctgaacaatacttggaacctggacgccgtgttgaactgtcgccacgatttcagttgccggacataccgcatagtacgaatgaacgaagtaagtataggccgcgtcaatactggcaaagggactatcaggacgccgaagctcgttctgattccaacccatctgtgggactttgacattcaagtccgttggcaaagcgctaacccggccgcttaacaagcctagcccagcatgctcgccgtactcggaactactttcaaacaagagctgcatgcctaagcaaataccgagaacgggtttgccactccgcgccaatgcttgtaacacgccgactaactggcgctcttttaaagcggccattgcagctgcgaaagctcccacaccgggtaaaataactgcgtcagcggccgctaattgttgcgggtcagccgttaagatggttgacacttgcaggtagtcaaaagctttcttcaaattacgggtattacccgtatcataatcgacgattgcaaacatttaaatcacgcctttcgtagagttgaccccctgaatatctggattaatcgtgacagctgcgcgcattgcccgcccaaacgctttgaacaaactttcaactttgtggtgagtgttacggccgtacaggatgcgtgcgtgcaaattcatttcagcagcaaaggccacggcttggaagaaatcttcgactgtctccgtatctaagccaccgagccgcggattcgtgagctcggcatcaaaaactaagtatgaccgtccacttaggtcgacactgacctgacctaaagtctcatccattggcacaaattccgtcccgtaccgttcaattccctgcttatcacccaacgcctgcttaaagcattcgccaagcacgattcccgtatcttcagtagtgtggtgcgggtcaacgtcgaggtcgccgtgacacttcatgaccaacccgaagcgcccgtgcttcgcaaataagttcaacatgtggttcaaaaagcctatcccggtatcgatttcgataccgctctgttcgtctaaattcaaactgatttcaatctgggtttctttcgtttcacgtttaatcgttgcttgtcgcatattcatttcctcctcatctgctaaaacgactaccggctgtgatcacaatcagtatcaactactaattacgccttaatcgtaataggtgtcaaaacgactctcaatcgcacgagcatggccttccagaccttcgacccgtgccaacgtggtaatcgccggagcttccttagccaaagcgtccttagtgtattggataaaggacgttcgcttaacgaaatcatagacgccaagtggtgatgagaaacgggccgtgccactcgttggtaagatgtggttcggaccagcaacgtagtcaccgagtggttcagaggcgtagcgtcctaagaagaccgacccggcatttttgattaaattcaagtactgagttggattcttcaattgcacttccaagtgttctggtgccaccgtattcatcaagtcaaacatttcttcaacctttgcgacaacggcaatgaagcctttttcgttaacagcgtcggtagcgatcgcttctcgtggcaaaactttcaactgtgacgtcacgttatcactgacggcctgcgctaagtcggcactatccgtaattaggattggccgggctcgacggtcatgttctgcttgactcaataagtcagccgctaattgccgaggatcagctgaatcatccgctaaaataccaatttctgacgggccggccaccatgtcgatcgccacctgaccaaagacctgcttcttagcagtcgccacaaaaatgttcccaggaccaataatcttgtcgaccgctggaatcgactcagtcccataagctaacgcagcaattgcttgagcgcctcccacttgatagatggcgtcgacgccagcgattttggctgcagcaagaacggctggattgatgccatcgacttgtggtggcgtcaccataatgacttcattaacgccggcaatcttagcgggcaaggcactcatcagtaaagtcgatggataggctgccgtgccacctggaacgtataagccaacccgattaagcggcattaacttctgccctcgtagaacgccaggctgttcagcatcaataaagccagtcgccttttccttttcgtgaaaactcgtgatattgcgtttagctaacaacaaggcgtccttcacttgcgggtccagattgttataagcatcatcaataacagtttgtgacaacttaaagtcggtcaaggtgaccttatcgaattgggtttcgtaatccttgacggcggcatccccgtttttaatcacattggcaataatttcgcgaaccgctgattcaacctttaagtcagtcaattgttgggtcttcgtttgaactaagcgttttaaactagctaaatcttcattaataattttcattagacaaactcctttggattattcgtatcaacaactgtggccaaccgatcaactaaatcaaagatggcggcttgttgctgttttaaggctaaccggttgaccactaggcgggtcgagactggttgtaaatagtcataaatttgtaaatggttctcacgaatcgtggtccccgtctcggtgatatctacgatggcgtcggctaagccagtcagtggtgctaattcaaccgagccttcaatcttaataatttcaacatcttggcccaagcgatcaaaataccgttgggtaatcaatgggtacttggtgccgatgattttgcgtcgtggtgcaacgggatcaaagtcggccgtggatgctagcacaaattggcacttaccaacccccaagtctaacagttcatattgggtactctcgtgttcagtcaaaatatcgctaccaacgatgccgatatcagcagcaccccgttcgaggaaggtcgtcacgtccggccctttcgctaaaataaactcatatggttgcgtctcagaatcaaaaatcaaccgccgttgcttgttgcggacttgcgaacaatccagtccagcttcttccagcaacggcaggacttgttgttcgacgcggcccttagtcaaggcaatctttaaacgtggttcagtcattggtcatacctccagttaaatcaatcagttgggcattcaaacgttgtgcttcgatgcgcgcacctgctaagtcatccgccaaactcaaaatggcgtgcggttgtttcgctaagtatgcctccgcttgtgaccactgttcaggctcaaagtaaatcaattgttcagcataagcggtctgttggtcggtggctaaagtcgttaacaagtcaacgtttaaccccattcccacagccggttctgcttcagcttgaaagttcgttaacagtttgtcgtaacggccgccgctgaacaggtagccagcccccgcttgtgaataaccccgaaaagtcaggccggtatagtatttttgtggtgcttggctactcaaatccaccgagatgacctgctccggcatcgtttgttgcatccaggccaccaccgtttgaagccgtttcagacttggttggactgtttcaggtagtggtgctgccgctaattctttgaagatacgttctggacgcccgaacaaacgcggccatgctttgagaaaatcgtataaaggctgtgcgcggtacttggcaatcaacttcgtgtagcgtggtacttgcttatcgaacagtgcggttaaaatggcttgttgttcgccttcgtcaccagtcaagctggccacgacccgttgtgcaaattgggcatctcctaattcgatttcaacagcatcggcaatcagctcacttgaaagctggttggcaatcgttaaacattcaaattcggctttcagcgatgcgtaaccgactaattcgactcccgcttgtgtgatttggttatatgaacctgataattgacggcttactcgaaagatatcgccgacataaccaaacttttgcggtaaggggacattcgtcgcgctaatgaagcgagcaactggtaaggtcatgtccggccgtaagaccaaggtgcgaccatcgttgccaaataagcggtatagttggtagttacccatctgatatggatcaaacaccgcttcgttttctaataacggcgttgcaattggcgcgagcccgcgttgtttaaaatgggcttggatcaccgcgatcaagtgttgtttggtacgtgcccgccgaccaaattcatcccgggttcctagtggtaataagtgtttcaacataatttacgcctcctaaaacgtcgttatttttaaaactaatcagtttaattcatatcgttacttatcaacgtgcttaatcaattgcttacatgctaaccggagcgacttgcgattccgtcacgcaaacttaccgcatggatcggtgaaactaaaaaacgcccccttagcaatttgctaaaaggacgtttacgcgtggttccaccttatttcatctaccgttcgcacggcagacctcatgttgatcaagtcaacttggataacgaaaccaattcggctaaggctaatgagactggttcaccttagcagttcatagatgtgtgttcgttaagcctgtctgtccggttctcagctacccgggctctctggatgaggaagacttaattacttgttctaatcacaaccgtttattaaaatttgattagtcgtttaatttataattcattgtaatcactaaactgacggctgtcaaccctcaattaatttttttataagatgatagccacgccccacactggctatgtcgtgggcatcagagccataaaccagcggaatgtcaagcttttgagcgcgttgtagaatctgttcaccgggataaaaatcattacaatacggtttgtagagaccagccaaattcaaatctaactgccgccgttgctgcttcactaacgccaacgtctgatctactaattgaagattatggacatccaagggttcagtcaagccaaagtaatcctgatatttgcggacgagactcatgtggccgatccgttgtggtgcgtaagggcccagatctgcttgtactgatgccaagaccgtctgataatactgttcaaaaacacgttggggcgtcttaagccactgcccaaaaccggctgcaaaatcatccgttgacatgtcaacacaccagaaatgctgccgtaacccccgcatgaaatggactgacaaaatactttcctgcgtccgaggaccataggtattcagaaaatcacgcgtccaagcaacatgctctggtaagaaatcaacttcaaaacccactgagatctcgatttgcccggcatatttggtcttcagtccgttagccagtgccaaataatcggctacttggtcctcacgcaacgacgcctcagtataaccggccggcgtcccttcatactggtcacgaaatgccggtggtaacggtgcgtgctccgtgatacaataccgctgaaaacctagctgtatcgcccgttgaatcattttttccgttgcttcaccactcccatgcggacatagttccgtgtgggtatgcccatccattagcatatcctcatcaccctctcataatttatgcttattcaatcatattttttttagataagcaagtatggtcgaaacggtcattcgcgacaatacgctagcagtcacggcgaaagtctaacaatttacttatttatttatattaatcgtcacaatttctttataccatgatatagtcaacattagttaaagaacagcgctattcccaaaaaaggggggaccggccatgcacgaactcattacaaaactttatcaactcgcactttccagtcacattgtcagtacgttgctggaacccgtgcacatcgttatcttagctttacccatcatgaccttactactcgccatgattatcctgactatccagctccgaacacgtcaaacactgagtgagcgtaacttgatcagtacctattcgtttatttggtacttggcagcagcctacttactaattattctgccactcccgactcgctcatccgtggctagcctaacaactgctgagtataatttacaacccttctactttctcacccagttgaaggcactcacgccgtttgaactcggggaccccagtacttggttagccgccttcaaatctgacacgttcttccagccgttcttcaatattctattatttatgccgattggtgcctacttaaagtggcggcaccgctggccgctctggttgatcaccctgacgagcttctcgatttcattgttcttcgaaaccacgcagttaaccggattatacggctactactcacgagcctaccggatgttcgatgtcgacgatttaatgatgaacacacttggtgggattgtcggtgctgggtgtctacatctgattcctaaacagtggcgcaatcgcgaccacagtacccggttgaattggcaggaacaccccatcaattggcgccgcattggggcgttggtcatcgattggctcgcaattgccgcctttgacaccgtctacttcgtcttagtcaaacattttaattggccattaccacatgattttcgctggctatacctggccgatatcatcctcttcttcattgggcccgcctggtgttggcatggtaaaaccattggtggtcgcctgctcaatagtcagatcgtaaccatcagtggtcaccaggccaatctctggcaactgcttatccattacagtgggctctacctaatcggcctgccacttttattcttggatttatggttattcaatcgtctaggcaacgttcctagtgccacccttaaccgcctggatgtctaccttgtcgtcgtttcagtcattttactgattatcagttatgatttattgttagcgcttttcagtcgcagtcaccagttatggtgtgaaaagttaagtagaacaactgttaaataattaggtggccttaaaacttcctttgcgttgtctcgcaactcatgttaaattgaagatatctcaaaacgctggaagtaaaaacaatgataaaagtccatgaactaagcgacgattttcgctgggtcgctgttaataattacactgaaaatgattatcatcaactcgtaagtgaggaacacgttaccgacgaaatgttaggctacgcaaccgatcaacacgaacgaggccggttggaatatgacgccaaaagtgccatcacgaccattatttttgacgtggtcacagaagacgttgaggaaggtacttataccgcccaagtcagtttcatgttgattgaccacaccctactgacttttacgaccgataacacaatattcgttgaggatatgttggcagacgaaatcgatgccgattgggaagatgtcctgcatccatacgaccatatctttaacgtcttgtacaagctatcacggcaatatttttcggccatcaacaagatcaataaacaacgccaagacattcagatgaagatgaaaaagcaaattcagcgttcagtcattattcaattgatggacttagaaacaacgctagtctatttcctcacgtcccttaaaagtaataacgacatgttgcagtcactcaaacggtttgtaccggtcaaattctcggcggcccaattagaacggctcgacgatattattgtcgaggcacaacaaggattggaaatggccaacattgcctcagacatcatcggccgggtgtcgaacgcctactcgaacattctagacaacagtttgaacaacacgatgtgggtgctgacgattttctccatcgtcctgacaatgcccaacattgtcttcggttttttcgggcaaaacgtcgacttaccgttcatgaagaatccattcggttgggagattacggtattcatcgccgttgcactatgtgccctaaccatttggttgctacgacgcaattcatttcgaaagtaaaggaagcttttactcatgcctaatcgtccccaagtgactgatacgacggcctacattaatcaggttgccgaagcggcccaaccaatcctcaataatctcgtgcagctgattaccactgaactgccggattttaaggctagaattaaatggaacttgccgttttacgaacgtgacaagcactatgtcagtatcgccgcttacaaagcccacgtcagcctgagcatctcagctgatttggatgacgccacactagccgctgctaagtccgcgggctatccaaccgggcaaaagcgcctgaatctgccactgacaaagccggtcccgacggcgctcgtacagcaagtcttgcagttgattgcttgacatgcgtttaacttatcgaactgaccttcacgacccaaatggcttcaccaagcaacccgcaacttgattttcaaagcgtcgttaattgaacgacgatgcgttaagactaccggaattctatgatatatctcagcgaaaatcattaaaatataaaaacgcgtcagcttgaaacttcattgagctggcgcgttttcaattggggtatcatttccgtgaactaccgacgacgtaaactttagtccttgacgttcgcaaagtgggcaagttcctcaagctaaccagacgctttcaagtgccggtcatattcccggtctagatccggtcgcacttcagtcgtaccgggaacgaagtggatatcctcatgttccgcctctgtcgcggtctgataggaccactccttcgccagattctggcttggaataactgctcgcttgaacccccaaatgatgcctgcaatcacaacttgatccggcgttacagacatcattggccgcgtgtctgataaccacgtgaatattctgacgcacaattttgctgtgagtatcaaaaaaagctggtcgccagaattaatattctagcaaccagcttttcattacccttaacaaattagttttattgcatgtgcaataaacccatcttgtccatggtttccgcaatctgaactgagttccaagcagcaccctttaagaggttgtcggaaacgttccacatgtggaaggcttgtggcgtttcttggtcaggacgaacccgaccaacgaacgtgtctttagaaccttccgcattatgcgcttgcggataaatttggttatcagggtcgtcttgtaagaccacgcctggtgcagctgccaaagcatcttgaatgcccttgacggttgccttaggatcttcaacttcaaagtaaactgattcggagtgactcactggcaccggaatccgcacacaagttgccgttactttgatatccttactgtccatgtcgccgccacacataatctttttggtttcatggatcatcttccattcttcatgggtgtagccatcttcttcaaacacgtcaatttgtggtaaggcattgaaggcaattggataatgctttttgtcgcccgcaacaggtaagatatgagcttccatctcttcaccttttaagtaggcttccgtctcatcatgcaattccttcaaggcccggttaccagcaccaccaacggcttgataggttgaaacaatgacccgcttcaaaccaaatgccttgcgcactggttccaaagcaacgaccatttggatggttgagcagttcgggttagccacgattccatgatgaagcttcaatgcttcagggttaacttcaggaacaactaacggaatctttgggtccatccggaaagcactcgtattatcaacaactacggcaccccgtttgactgcttcaggggcgaacttcttagatactgagccacccgctgagaagagggctaaatcaattccttcgaatgattcaggaacggtctcttcaacagttaaggcttgaccattgaactgtaattgtttaccggctgaacggcttgatgccaaaagtttaactgagttgacaggtaaactcgtctgttccaccattttgatcatccgcgcgccaactgcaccagttgcaccgacaatcgcgacgttatatccactcactatgaagacctcgctttgatagttattgaaacctcattatagcacgtttgtaaagattagaaaataatgagttccatccgaccataaattaatctgtcactgattgcactgccagctgttttgcacacgcagatcatcaaaaaaagtaaccgttaccatcattaattaaacagtcatttagctgtcgcctattttgacgtataatgaacctaattcaaaggaggccgcgccatgtgtaccagcttaacttatcttgatactgacaatcaccgctacttcgcccgcaccatggactttccaacaacgacaccttggcggccaatttttttgccgcgccgttatccgtggccaactgggttagcgacgacgcgtatgacgcagtatgccattctcggtggtggtcggctacctgaccactttaaggcttgtttgatggctgacggcattaacgaagctggtttgatgtgtgctgaactgtacttgccccacgccgttgaatacgccactcaaccacaagtcaaccaaattaatttaacaccccaagccttcatcaactgggctttaggtgaacaccaatcagtcgcagccgtgatcgccgatctgccaagtgttaacctggtcggtgcgtcctggggtgatgacactggtgaagtctatccctttcactggtatctcagtgatgcacacaccagtgccgtcatcgaacccactggtggcccactgacggcgcaaccgaatccagccggcgtcctgaccaatacaccagtcctaagcgaccatcagcgccgactaaatcgttatttagcagtatctggcaaccagattacaactgccactcgtcaggctgctcagcacgtgattcagactaagcaaccattaccgagcgggccgattcccactgatcgtttcattcacatggcacttcgacgactgggaacaccgcagctagcaccgcaacaagtgccgaccactttattccgctggttacaagaagtaagcttgccataccacgccgaccgtcgccatctcatcagccacaactacacgcactatcgttgtttgatcacgttagcgactcgtacttaccgctttattccacgcacgactggtcacgaacaacgactgacactaacacctgaaatggcaacaacctggcgaacaccgtacctctttcctgccgattgaaactaaaaaatcacgatgttgagactgaactcacatcgtgatttttaattaatgacgctgcttcaaaaaatgatcaaattcctgattgattgctgctcgtacttggggctcatgtaaatcagcttgcgctgcattcggaccacccgtaacttgactaaccacttgcaaatagccgaacaagacctggctggggtcaagatgatactgcttggctaacgtcacggcgagatcataacgatcaggtcctaataaacttgaataatccattatgccgtccctcccttcgcctgttctagctggcgactcatccgtaagtaggccaaaaagtgaaaaatgatgccacctgctagtaagattgcacctaaccataccgaccaaaacgttgccacgatggctaagccataaatcgtgacacttcgaaccggatcaaacttaattgcggtataaaaagccattgagattcccggcttctttagatcctggtgatgatgcagataagcgtacatgaaataaaatgtcgccgaaataaacagggcaaccaaatcataaacgataaatgccgtttgcatatcctgtcgattaccagttgtcaacgcatctgccactaatgacatcgggtaatccaataaggtgatactaaagagcattaataagtttagcatattaacgttgcgatcaattcgttgtagcatgttgaaataatcatgatgaaataaccacagcgtgccaacgtagaaatacgaaaagacatacgacaagatcaacggccattgcgctaatagtgccgccagtaaatgtcccggttggtaatcaggaatgtgaaattctaagactaaaattgtaattaaaatggcaaaaataccatcactgaacgcctgaaatcgatctgttttcaaaatcagcacctcccacagcgttttaggataccataactcacaagtaattactgtaattaacttttcaaactgacgaccaaactgcttctctaacacctgatatggtaagattaagtcaaaataaagtaattgatgtgggggcgtcaagacgaatgcgaaaattattaaaaccaaagtggttgttcttatttttctggggaatcgtggtgtttgcaagtattctgattttaccgaacattaccacgtttgtgaatgaacaaaccgcaatgccacaagatgcaacaacgagtcctaaatatcaacaacaatggggtcacgggttaaccaacagccagtccttaacgttagtcttcaacaattcaaatggtaaattatccaaacagcaacgccaacaaatctccacgaccctagccaaacttaatcgccgagccgatgattatggcattaaccagcttcgaacgccaaccggtatgactaatgactggcacttattacgttccaatgatggttccaccgaattagcccttgtcgccgttcagacatcccgggctgacctatctgtgattgcaaatcaacttaataatgcgattgcaatcgccgacctcaatacgagtgtcgccagtacggacttgatctaccaacaacacgtgcaacaacaacgtcgcaacttgctgattagcatgcttgtcggtagtctgctcagtttaatcattctcggcctcatcttccgctcactgttagtgccattactgaacttactgtgtcaagtggtcactctgatcacaacgattagctttatcactaacgcgcgtttagcttggcattggccactgacggctaatgcgctgagccttgctggtctaatcagtttaatactgactagtctattgacatggcactttatgtacgcgtattggcaatcgagcgcaccaaccgcaccgaccactgtcagtctcaaaattctgacacttcaatatcgacagtgggcacttgtttttatcccattaatactcataaccatcactttacactggactgccttcatctcattagccgctgcttgggccattactgtagcgcttggaatcaccttactggcggtaccgccgctcaattacgcctttaccgcttggctcggtgataatttattttggccaggaacaacggcttggccgacccgtccacgcaatctatggggccaattgagcaagttcggctactggcagccagcgcttgggagcttggccgtcgcactgttactactccccggcctcattcttgctaacggccagtttgccgatgacaacttacgaccctggcgccaaaatcagcttagtaatgctgaattaggtcagcaattagtccaagctcacttcggtaccggtgccacggcgccaatcacaattacactacgagcaccgcagaatttaacgcagcagcaatcattacaaacaatcgatcacctgacgactaaactgcgggccgtaccaaatgtggctcaagtcatctcagtgacccagcccaccggccaaccactaagtaatttctacgttaaccagcaacttgcgactatcaacattgatttggctggtaaactgacgagtatggcgaaactcaagagccaactcacgactgaccaacaaagtctggaacaagcagcgactagtcgccataccaagtcggtcgaccagttgtccgaccgcatcaatgatttggctgaactgaatgatcaagtgcaacggcaattacaggctattgacacgacgctaacgacatcagctgaggctgaacccgatttaaccaaagtcaatcagcaggtcaccaagttagatcacctgactgaccgcatgacaaccgcactaaatcacgtggtaacggcccaaactacggtcgcaaccgaagctggacacgttgatcagcgtgttcaccacgtcaaccaatcattgaagcagaccgttcaacccttaaccaccttactcgcttcactgaaaaatacgaagacctatctacatgatttagccgctagtcaagttggccggagtttttacctgcctgctaacgcggctactaatcaggcctatcaaaacagtctttttactaatattagtagtgatttaagcatgacacagctaacggtcactttgaaatcagcgccggctagtgcggctagtcgcaggaccctgcaacgacttcaggcagtcacccacgacagcctactcgccacgcccttagcgcacgccaaaatcctaacaaccggggtaacacagcaacagcactatcagcataccctgattgcgacccacgcactgagatggctcacactcggattaatcatcggcatagttgttttatggttcggcctgcgttcattgaccttcagtctgttaatgaccgcgtgcttaactggcgtgacgttaactagttggggttggacccagttaatattaacacgctggttgcaaaccgggccgctcagtagcagtgtcttgcttggtagcttgatgttgttgacactgcactggctaatgattaccaccgcaaccggttaccgtcaaagttggttacggcacttggagcccgctcatctgcaacagcacttttatactagtggacgattcgtttgcccggtaacaatgattgaattgacctacttactgccactgcttttgacgaccgcaccaaccttaaaggggcttgcactcatgagtctcattgggattacgataagtaacctcatcgttccattgggattttcagggtggacacgttgggctaatgagccaccagctatagccacgctttggcagcactttcgcccatcatctatcaaccgctagcaattgattagcctaatctttgagtaaaaaaagttgcttttccagacgtcaaatctggaaaagcaacttttttacaatactaaattgaatcgtagcaaactgccaatcgtttatacttaatgattgtgtgagcaccggtaatctgatagtcaccgctgactaactcaatatcgtcatactagcaacgacaaagactaataaggtcatcgccatccgccattcactgtgccaaagattttgcgtgtgccaccacacggctaacaatctccacatcagctagctagaccatattgcttaatcgtaactcacacgatgattcaaatttattgattgaaattctgaactgaccccgtaaacaatgttagctctacacataaccaaaacaatgccccagaaaccataaaatttctggggcatcatcaatccctacatgatactttaataaatcaattcatgcgtcttcaagtacgacggcgataaccgattcccaccgcggcaattaacaagcccaaaagcccggcaaaaatcacccaaattggcgactgcttctcgctggtttgcggcaaagttccgtggttatagccagctgatgtgctttggtcactaccagttggcgttccaaagccgttcataccagttgtcacaccattacccacagtgccaccagcaccattgacacccgtgcttggttgcttgatcagtcctggtaatgccggttgacctaatccagattgtcccggtttaggtgcagcgggttggcttggaccgggtacagctggtcgttccggttgtggcgcggttggccccgtggttccagggttacctggctcagtcgttcctggttcgcctggtttgcctggttggcttggttcagttgttcctggttcacccggtttacttggctcagtcgtccctggctcacccggttggcttggttcagtcgttcctggttcacccggtttacttggttcagttgttcctggttcacctggtttgcctggtttgcctggttcagtgaccggttcatcagttgctgctaccgttaccactgccgtttgattcggcttgattgtaaatgataacggtgccgcattaagctgataaccactaggcgctttagtttcaacaaattgataattgcccgcggtcagaccagatacggtaagttgaccagtggtatccgtcgttaatcccatcttgagcactttgccagtggcatcttgcaattcataaacggccccagccaatgccgccttggtcgtggcatcagtcttggttaacgtgacatcaccagttgtcggcacaactggttgcttgacatcatcctgacttacctgaaaagcaacctctggcttaataccgccgagagtaaattttactggggtggtattaagttcatacccaagcggagccttggtttcaacgaactgataatcaccagcacgtagatttttgacaatcaattgtccctgcgaatcagtcgtcaacccagtttggattaccttgcccgtactatcttgcaattcataaacggctccagccaacacggccttggttgccgcatcatgcttcgttaattcgatggtataggtcatccctgctgttccattgccaccataggtaatatcggccgtcgcatcaacgcctagtccatccagtgcagccgtattatgccatttagctgtgtcagccggattaaaattctcaaccttagtgttataagtaatcacaaacggcgaatgaatgttgttaaacgtaaaagtaatcacgttaccattagttgcaacagtcggtgttaacggttgctgtggcacttggataccattgataatttgcacggcctgtgccgcaaccgaatctggaatgaatgtctgattgggccctagcgtatctgtaaccacaaccgtcgagttattgcccggtgtcacggtaatgtgccatcccaataccgttggcgcaccatcacttcccgacgaaacaaccaagccacttttagcaatttcggctgatccttccgtcgccgtcgcattgcccttcgcattcatgctcagtgtgccagcccgactattgagtgtacccaacgcatccgtaaacgtgatcgtcccagtactggcacctttcgtatacgtaaacgtgcccaaggtttgcccggcagaatctgttaacggcatcacaacatcatgatcgatactgacgtacgttggaatctcaacggttgctgtatcgccggctttaatcacttcagaatctggaatactccaatgatacgttaattggtagccagccttatcattcaacgtacttgtgtcagtaacgggtttgccattcgcatcaagcacgatggcattgccagccgttaaaccagtaacactgatttctttagcatgtgcagtactccccagcataaatagcgctaatattaccgtcaacatgcttagcatatacccaactagctttcttcgcatacgctcctcccccattcaaaaaaagctttgtctttgtcattctcacaacccaacacaccctcacagtcgcgtatgattgtcagggtcggccaccagttagtgattcacgctaatcagctccatatgtacaatactgcaaccaactagtttactacgaatcaaaacttttatttgcgaactatccgaactaatcgtttagcaaaaaagacccccagagctgtactagtccctgtcaagttgtcatttgaaataatataagttttgctttgcttaaacggcctcattccagtattccgctggggtgaggtcgtttcttgctggtgaacgatctagttgattaaaatagttgatgccttcttcgaccaaggccactaattctttataggtaactggtttagcgtgtcgatcaatccagcacaatttgaactcgttccaccaacgttccattagtgcgttatcatacggcgttcctggtcgtgacatactacgggtgacttcatgttgcgccaaaaagttattgtaagagacgttaaaatgttcggcggcttcactgtatgaatgattacctttattaatccactccacaatttctacacgttcattaaaagttgttttacggctcattttagggacctgctttctagacggcgaagccgtcacagtttggtctctattatacttgattagtcagtttcttagctgtgaagttgagcgcatttggtatttattagttaattcttgaagtgttccctcgccattcaaatatgcttgaataatcattttcttgaacgctttactgtaatgctgattcttagtgggtgccattaatccattgataccatcgcgttgaagacgtaattcccattgaccaatggtgtgatgatccaacccatgttgcttactaaatgcagtaatagaaagactggagctctgaaactcagtaattaaagccagtttttcggctagtgtatatctagaccttggcatacaaaaatccctttatggttgtcagatgaattatattatttcatctgacaaccataaagggatcatagcaacccaagcctagaagtctattggaaattccatttatttatcccactaaaaagttaccacgaaactaaagcctaaattgcaggcgcctttattctggaatatgactcgaatcaacaacctaaccaactgaaagttacgccaatatgcttacgacaatgtcaatatcatcgtctgatgtcgcaaacccgcctccataaacgggcgcccttgtggctgataccctaattgtgtataaaacccttgtgcagtgacttgagcgcctagtaccaactgtcgccaaccacggctcagcccatccgctgcaatccgttgaagcaattgtcgtgcatagccctgccctcgcgccgctttcaacgtagcaactcgttgaacatgccccgtccattggtcgctaggtgtcactcgcgctgtggctaccgcctgcttttgatcatcatacaagacgtagtgccacgtcgctggagtgaccgtatcaatttccaaagtttcatcgatatgttgttcctgcacaaagactgcccgccggattgcaatggcatccgcataaactgatgaatcaacctggttactcatttttatctgcatcacgttatcacccgttcttctgaaatactttgagaatacgcgtttcaccggttatcgtcaaactaactcgaaacgaaattaacgcattcttaaaattgttagcgattacgagttccgatgttatgttaaaatgatttgatgactggttatcgagtcatatccaaatttgttaaaaatgaggtctttatcgatgtttaccaaatttcgccaatacgttaacacgcgaattggatttttttggctactagtcttcttattctgggccaaaacgatctatgcgtacttaaccgaattttcactaggcgttgccgatccactccaggcattcctgacgctcgtgaacccgattgcaacgacggtctttctgtttagtctggcgttctacattcgtaaaaccggtgtatattactatattttgctattcattgatgcactcgacaccattttactgtatgccaacgttatctaccatcgtgaattcacggatttcatgactgttagtacgattaccggcgtgtccaaggtcagtcagggacttaccggctcatcgttagccctagcgagttggggcgatgttctttactgggcggatattattgtcattctggccttggtcattcttcatcggattaagcaagacacacgaccaattaagaaacacacggcctttgcgtacacctctgccgcgattgcaggtttcggtcttaacttgaccttagcagaatccaaccgaccacaactactaaccagaacgtttgaccgcacttatatcgtcaaatatcttggtatagatgcttttacagtctatgatggtatcaaggatgaacagaccaatcatcaacgcgccagcgcaaagaaatcagaattagataccgttaaagattatactgaatcacactatgccgcgccaaacgctaagatgtacggtctggcgaagggtcgcaacgtcattgtgattcatctagaaagttttcaacaatttcttattgatcagaaagtcaacggtaaggaagttacgccgttcttaaataaactgtatcatagcaactcaacttacagttttaagaactttttccaccaagttggtcaagggaaaacttctgatgccgaaaatatgcttgaaactagtacttacgggctctcaactggatcattgttctcccaattaggctcagataatacgttccaggccgctcccgcgattctaaaccaacgggccaattattcctccgccgtcttccacggtaacgtggccagtttctggaatcgaaataacacgtataagaatatggggtaccaatatttctttgatgccagttatttcgatacgactggtgataaatcaactggatatggtctaaaggataagctgttatttaagaattcagttcagtatcttgaacggctacaacaaccgttctacgtcaaatacatcacggtaacgaaccacttcccattcacacttgataaggaagacacgacgtttaagacaacggatactagtgattccgccattaacggttacttccagaccgcccactacctcgatcaatccgtcaaagaattctatacctacttgcaaaaggctggtttattaaagaattcgatgatcgtactctatggtgaccactacggcttatccaacagtgaaaactcgaccttggcacctattctcggtaaatctgcggacgattggacttcctttgatagcgcccagcttcaacgtgtgccattcatgatcaatattccaggaatcaagagtggtaaagtcgaatcgacttatggcggtgaaattgacgtcctaccaacgattctgcacttactagggatttcaagcaaacgttatattcagtttgggaccgacctcttctctaaacaacacgatagtaccgttgcgtttagaaatcgcgatttcgtcacgtctaaatacaccgtccttagcggcaaaatttatgacaacgcaactggcgaaacgattgatgatgatgaggcagttcagaagactgttgataaagatcagaagaaagtcgacaaagaattaagcctctctgattcacttaacaataaaaatttgttacgtttctacacccctaagggcttcaagaaagtcgacgcttctaattacaattacgccgatggccttgaaaaagaaattcagattcaaaataaattagctggcaagtcaaccagtctctactcgaagaatggtaataagtcaacggactcgttgtatacgaccgacgcaccggaagcttcgcataagaagactgattctactcgtatcaagattaccaaccctgatgatacggatagtaccacgactagctctagcagttccaaatagcaacaagccttccatttacagtgcaaggcgcgacggcaatttatttgccatcgcgcctttttatgatctcctttaaatatgacgctgccctcatccatctggcatcggttgcatgataaaatactaattgtggtttgtctcatgcttgcgcattacgatgattaacacgtgccatctcttaagttcagtgccgttcatcagccattcgcgcggattaccgaaacgtgctcggtagccccattatgcttagttgaaagtggtttcctagagtgactaatctaagcaattatttagataaaaataactaacacaatgcgtgttacaataaaattaataatgacttgattcgtcaatgccggatcaagggaggaggcaccacgcatgggcgcttggcgtttttggtgggatagtacccgccgtttttataagaactggggcagttacgttgccctgatatttagtaccaatttggtcattagttacctagcaattcctttttttaattgggtgctagaaatgttactcaagtggcaacgggtcagttatgtctcgtacacgaatatcggtagtattattattcaccaaccactggccgcactcggtatggtggcgatcttattagccattattattttagtttattggcaatttgcgtttctgctactgggtattatgaatatctttcgtggccgaccacaaactgtacgcgcggtcttgcggtcaacggtcactagtctgactggcacctcacccagcactttcttattctttatcggctactttattgtgattttgccatttggaagtttcatctttacaacaccattactcaacaaggccaaaattccagccttcattgtcagctatctcatggaaaacccgtggatgacgctcggcttggggtgcttctacttgctggctggttaccttggaattcgcctaattagcctattaccgctaatgattgtcgatcggcttccatggaaaacggccgttactcgtagttggcaacaaacgcgccaccatctttggcgctacttatggaccatgattgtgaccttatttatgatttttctgatcgtcacgaccatttatacgttgatttacgtcgcccagcttcaattcgataaaacaagttttgccatggccgctgccactgttaatctctttatcatggaagcaatcaccgaaattattatttgttataccacggccatcttcatgatgttaattattgtttgctatcgtcaagactttacactcctccgccaacaaccgcaatactttaacgaggcaccacggttgcgcaaattgacccgggcgagtgttgcaattggcttgctgttagcgacaagtttgctagttgccgttaatttagtctacttaaatggactagtgattaccaagccaatcatgatttcccaccgcggcgtcgataacggtaacggcgtgcaaaacacaattcctgcactgatcaagaccagcaaggaacatccggattacgttgagatggacatccaagtcaccaaggaccatcaattcgttgtcatgcatgatccaaccttaaaagccttagctggcgttaagaaaaagccatctcaattaacattaaaacaactagaaaaaattactgttcgtgaaaatggctatcaggcaaagattccaagtttcgatgcttacctgaaagcggctcacaagcatcatcaaaaactattagtcgaaatcaagaccagctcggcttacaccgccgccgatactaaacggttcatcgatcgttatggtgcgaccctactggctcatcatgaccaagtccatacgcttagtttcaaagtcatgcgtgacttgaaacgcttagatcaaaaacaattcgttagttacatcttgccttataatctcacgttcccgcatacagtcgcgaacggctacaccatggaggtcaccacattaaacgaccaattcgttgacaaggctgaccgcaatcacaagacggtttacgcctgggacattgataatacggaccaaatggatcaaatgatgttcatgggcgtcaccggcgtagtcactgataatctaacggaaatgcagcaagaagttaagagcaacaccgaccatcccagctatgccaaactcttattgacttttatgaatgaattaagtctaactagcaacgagtaatccacattatttcaaagttgctgtcacagcgagtgcataaatcattcagcaaccacgaaaattctgaatgatgtcgttgctgaaaaagtgacttccagctgatgacgaatcgtaagcgccatctgaatgcataagtgcatttggatagcgcttttttgatctgattagccgtcgcggtgattgagatgttggtaaaaaactgtattaaagtgcgcagcgctccgggttatctgccattttaatttctaaagcgcacgaatgccgatagttgatcagccactgatttttaatacttttaccgccaattaggtgctcatatggaatgacccagaaacagggtctgaaccatgaagtcctttgatgacagtacgttatcagggacgtcaatattagataaaaaccagaaagagccatgagttatcatgactccgtaagcaacagattggtagcagttcgtcctacttttgcttgtgtctcaacacaacaaccgaaatacccaaaattccaagaactattggaacatcgattgcggtaaccggcaatccaaattgcgataaaatgtaaatgaagcatactattaataaaacaccaccgtatttttaaaaaaaaccgataattacattgtctggataacgcttttttaaatacagtaatagaaaaataaaacacaaataaagtatcgtatgcttcacaacacttagtgacatataaaatctaatcatctaaactaacacaccatcaataatggaaccttttgccataaacagaatcatcctctcaaattctacgttaacaacaggcagtatgttacgaatttatcttaacaacagcgtttctttatcgttatcaattttcagtaaattttgtgtatttttttgtacaaacttatacattgtaaaagtttagccggagcgaccggttgtttttttattttaagacacaccaaagctatctagattgaaaaaaacatttgcctttctaccacttcatggtacaacaggccgccaataaagcgggttcttaaaggaacaagcaaataggacgagaagccaagattcggtttctcgtcctatttgcttgtatagcgccagttatatcgcaactcttttaaacttacattttttcaaacacggtcgtactatgcagtggactccgtcgttcgggatacaaggtcatcattaactgattgaccgcgttaggagcttccccgaagccactggcaatcaagcctaacttgcccgcgtaagtcaccgtatcaccaatagccgcaatcccaggtacgtcggtattcatctccgtatcaacggtgatgagtcggtgggccatggttggggtcacgtgccagtttcggatgactttattatccgcgataaagccatagttaacaatcaaatcatcaacggccaatgtttcttcagttgtgccgcgaacctctttcatcgtcagctgtaactgtccggtagccgtctctgcaagttgcttaatcaaaaatggcgtcttgatttcaacggaagacgcttttaacaagtccacattgtgttccatcccacggaaccgatcacgccgatgcatgatataaacgtgcttagcaacgggttcaagcatcaaggccatatcgatggctgagtcgccaccacccgcaactagtaccgttcgatccgcaaattgcttgacacttggaatgtggtagaataattgcttattctcaaattcagccgcattatcgactgctaagcgccggggttcaaaagccccactcccagtcgctacgataatcgctttggaatgtgactgctgtccactcgccgtggtaatcgtgaaatcacccatcgctcccgtgacatccgtcaccgggctcgccaattgaatgtcaattggaaattgtgtgagttgcttttcaagttgtgccaccagttcacggcccttgattgccggatatcccgcaacgtcatgaatgatcttctcaggatacaaagcctgaacctgaccccctaattcggggagactttctaataactgaacccgtgcattacgcataccagcatagaaggctgcaaacatgccgaccgggccaccaccaataattgttaaatcatattctgcactcatcgtttcccagctctcttctatgtagacttattgcttctcattctagtggattcggcgaaggtttgcaaaagcaatttttactaattcgactataataggattcaaaggcgaggtggatcagtgatgcgacgaattaaaattattaaaatcatggccattattagtgcgaccctggtcgtagggattggatcctattggcaacatcgcttgaccccattacgaaaaacgcgggtcgcccaaacgagtattccgaccatcttcgtcggtggcgattacgcgcgcgcattttctaccgacggctttgtgcaccgcttaaccgcggcacacctgatgacgaaaggattggtcgtccatgttagtcacgccggccacgtgactgtccaacagttcggaccactaaaaaacaacccaacgattcaggttatctttgccgataatcatcatgcgaaacgtcaagctcggcagtttgctactgtcatgcaagggctcgcaaagcgctaccacgtgacccgctacaatgctgtcggtcactcatctggaggtaatatcatctttgattatctgacagcgcaagtcccccagcgcgcacaaatcaataagtttgtgaccattggctcgacctatccgggcttgaccactcagcagttaaaccggttaccacggtccttgccgatattgaatattgccggccatgtttggcatacaagtggtgatggcggcgtcaatttacaagccgtacttaaattcagccatcaattattggcagctggttggtcaccaaaaacccaaatcattcacggtagtcccctgaccgccagccactcaatgttgcatatcaatccacaggtcgacttactcatcatccagttcttgtacggcaactgatcaattcatcgaggcgtgctgccaatcaacctgaagcacgccacacttctaatttaacaggattcggacacccttacgtcccttggatgggatggcaaatggtgtcttttctggtatcctaaaacatcacatatcagttaataacgcaatcacaaaaaagtctgctaaatctggccgcataccgttagttaagctagcaaacggtgttttgtcagcgatttccatgtacaatggtggtaatgtatgggtatatcttaatggaggcgattaccatgcgcaaaaaatggcgatggttattattagcactcactggaattttctttttgatgttcgggccacccttagttagtcaggcccgcaacgtaattgaagcaacgggcaacgatgttaatagtgcggttatcaaagatagtaagggcaagataatggctcacgatgcacaattgccagaagaccaagaatacacagtcaattacaactggcgcatccctgataacctcaagatcaaggtgggcgacacgatggctttccaagtccccgaaaacgttcgtattccgcatgacgaggcttttccaatgaaaggaaccactgcaggtaccatcggaaccttcttcattgctgccggcgcacatacgggtctcgtcacatttaatcaggcctatcaaaccagaccacgtaatcggaaagggtttgttcaattggacgccttcggaaccgttcctagtcatcctggtaacttagccccaattttattagagaaatcagctgaatgggctgacgaagctaatccacggcggatcaactggacaattcgtgtcttgcctaataacaatcagctcgtcgatcccacctttgttgatacgttgagtccgaaccaaacgtatgtcaatggcagcgccgtcctacgcgatgagacaggtaatattattcccgtcaatacgagcgtgaatggtaatcaattgacgtttaatgccacagggtcgtttacgtcagagttagctttgacctaccaaactaagactaacgaacccactggcgacgcaacttttgaaaataatgtcacctatactgacaagaacggcaacaagggatccgcgacagccacgatttcacggccagtcaccgaaccggacgttcccgaaaatccaggtatttcggaaccaacagatcccgatgaagatgaggaaccaggagttactgaaccggaaaaacctgggactaccgaacccgagaaacccggagtcaccgaaccagagaaacctgggactaccgaacccgagaaacccggagtcaccgaaccagaaaaacctgggactactgaaccagagaaacccggagtcaccgaaccagaaaaacctgggactaccgaacccgagaaacccggagtcaccgaaccagagaaacctgggactaccgaacctgagaaacccggagtcaccgaaccagaaaaacctgggactactgaaccggagaaacccggggtcactgaaccagaaaaacctgggactactgaaccggagaaacccggggtcactgaaccagaaaagccgggtaccgtctcaccagaacagccgagtggtcctaagcccaccaatccaggaaccgtaacacctgaaaaaccaacggccgtcactccagccgttccaaatgagtcgtctccatcgacccccgaaccaagcgtcagtggtaatctgtcagcacctgccaatccagcgacaaattcgactaacacgaccgccacaacggttccggcaactaatcccttaccagcatcggcagctacagcttttgcaggctcagcaccgatgaataagtcgttgccacaaactaacgaacactcggcaagttggtcagtagctatcggtctcgccttattgattggattactcggtagcgcttttgtcctgacacgccgaactaagcatcggcattcataattagcttgtcacaccgtcaaaaaaatgagctgctcacgtcgcgttgaactgacgatcaacggtgtgagtagctcattttttataatttcaacttgctgctagtaacactgcgcgatactttgttagtcggtctcacgatctagttgctccagcgccgtttttaattgtgcttgcgcactcgcatccagtgagggatacgctaatggcaattccgacaggcgttgattgatgatttccgaaacacagagccgcgaataccacttactatccgacggaatgacgtaccacggtgtcgctttagtagccgtcttggtgatagcatcatcataagcacgctgataatcatcccaatactgccgttcctgaatatcggcagctgagaatttccagttgtgacttggaatttcaatacggcgaataaaacgttgcttctgttccgcctttgacatgtgtaagaagaacttgagcactaagtagccgttgtgttgcaagtaatcttcaaagtaccgaagatcgttaaaacgacgttcaaaaaaagcatcatccacttgtttcttatcgttaatctcaccgacgtgctcattcacaataatttccggatggactcgactaacaagtacgtcttcataatacgaccgattgaagatcccaatcatgccgcgtttggggacccgatcatgaattcgccataaataatcatgcgcaatttctttagtagttggttgcttgaacgatgtgacttcacagccttgggggttgaccccactcatgatatggcgaatcatactgtccttacccgccgcatccatcgcctgaaaaatgactaaaacaccaaatcggtcttgtgcatataacttaccttgcagttcagtcagttgcttaatattcttggcaatttgcgccttgatgaccttttcgtcttcaaattctggatcaaccgccgttgctaatttagttaatcctaatttttgctttccagtatatcggtagtgcttttcaaaattcacgttctagcttcccctcaatttatcgatagtcaactaatgtcgctagcggttgatgatctgctggcttgccagcaacggccgctttgccaattgaaacgagcaatagtggccgataccgctgggcgtcaagttccaaaatagacgtgaatccggcagcatcaaacccggtcatcggattcgtatcaaagctatgatctttagccactaacataaattgcatcgcaatcaggccagcatctagggcgccaatggtctcgtcaccagtatcaaattgttgcccctgactggcctgaaacgctggcgcttggtgttgattttcacgatccagcacaaataagacgacggcactggccgtagttaactgactggtattaccagtcgcggcacacaaccgttgtcgcaaggctgcatcctcaatcaccaacgcccgaatcggttgttgattcaatgcggttggtgccaaaaatgcggtctgtaacatcgcggccatttcttcacgcccaattttagtttggccgtcatattgccgaaccgaatggcgcgcattcatgattgcttctaatggactattcgtcgtcatcagcttcaccttccttaattgtcagtataaaacagccttcaacatttcgccagtaagcgtggtcgtgaaatatttccgaacatttttctgttcaatgttaatttaattcgccgctagccgttgtcagcatcagctgaaacgtttacaattaaaacatagctttatagcgcttcagacctaatcagggaggatgttttacatggcaaaacgtaaaatgattttagacttagacaccgggattgacgacgcaatggccattgcctacgcagtcggtgcacccgacgttgatttaattgggattatcagttcttatgggaactgcctagtggatcaggcggcgattaacagtttacaaattctagaactactaggtgccactgacgtacccgtctttctaggtgaaccccactccagtacgacggaacactttgacgttatgccgatttcacagcagattcatggcatgaacggtatcggcgacgtgaaccttcctgaaccgaaacgcgccgtggaaaagcagtccggtgtcgacttcttaattgatgccgttcaccaatatggcgccgatctgaccctagtgccaaccggtcccttaaccaacttggccgaagcactcgaaaaagcaccagacattgccagcaccattggtaatgtgaccttaatgggtggtgcactgactgttccaggtaatgtcagtcactacgctgaagccaatattaatcaagatgccgaagcggccaacgccgtcttcaccagtacgatgcctcttacgatggtcggactcgacgtaacgttacggacattattaaccaagactgaaacacaacaatggcgggacttaaagacaactgcgggcgaaaaatttgctgacattgttgactattacattgcggcttacgatattacgagtcctgacttacacggttgtgccttacacgatccactggcagtcggcgtttcactcgatccaagttttgtcaccacgttagacctgaatatgtacgtccaggctagtggtgaagattatggccggacaattggtgaccctgcgcgactcaatgacccaactaacgtcacggttgcgttaacggtcgacaaggatcgttatttgaagacattcatgaattacctgacgacattatttaaagcccattagttatatttcatcatggcaaccggatcacagaagttcgcttccgtgatccggttgttattatttatttacaagtctgctaatttttcatttttccccggcaatttatgttaaattagcagtatcaccattcagaaagtaggtatcgccatggcacaaaaatattacgctgttcgtaagggacgccaacctggtatttaccgcacctggcccgaaactcaaaagcaagttagcggttatccacaagcacagtacaagagcttcacaagcgagaaagacgctcaggattttatggctggtaaggccccagctcactcaaaatcaatatctaatcaagcgccggtcaacgcagccattactgtttatactgatggcggttcgcgaaataccggaaacgttgccggtcagcacgtgcaccaagatgataaggctgcctgggcttatcggattgaaatgcccgaccaactcgtcactgactctgccggcgaatggggtgccaccaataatcgcatggaaatcatggccttcttacgagctcttgaacaattgcaacagcttggccaaactaagactgggattctgttcgtacttgattcacagtatgtcctcaacgcagtcactaagggctggctggctggttggaaacgacgcggctggaaacgcagcaatggtccgttagttaacgctgagttatggcgtgaagtcgaccggttgcttccagcattcactgcacttaattaccgctggactaagggccacgctaccaatcagggcaatgtctttgtcgatcatttgttgaatcaaactatggatcaaatgcacgctggtcagccggcccaagcctcgactggtgctaaaattagtccacagccagctaaaactagtgtgccacagccgactatgtcgaacccaacaccaactaagtctaatcaatcggccactgtacgctcgacaccagctgaaaaaaagccagttgatcccgaacaagtcgcccgttcagtagcggcgatcaagaagatgctacgcgataactaatcaaaaactgtgaccccaacatactgattgctggaaccgaattccgcaagtcaactgtttggatcacagttttatttcattaaaatttatagccaaccaattttttttagtccattggcgatgccatcgtgatcacaatcggtcgtcgtaatgtctgctaatgctttaatctcagctttcgcgttacccatagcgaccccaataccggcgctctgaatcatctctcggtcattatcattatcaccaaaagccgcaacgttactcgaatcgacattaagtgacgctgccagttttgcaattccttgcgccttagatcccactttgggaatgatatcaaccccgcgttcatgaaaacgaacaaaggaaaactcatctggatgcggcaacaatcgattttggacatccgggtaaaacatcatggcctgatacacatcatggtgctgatagtaatcaggggcataatccaactcaggtgcccgaaacgtgttcaacacctggcgcgtcgtggtggacggatgtgtgtggatatgtagcccatccagtgattcgaccacaatatcaatattctgtttatccgccgccgcaaccaatttgccaacattgtctttagataaggtgtgttgatgaatttgttggcgaccagcaaacgctgctgaaccattgcacagtacataatcttgtaattgtaaggcattaataactggccgggccatcgctaaattgcgacccgtggcaatggctacatgaatcccgtcatctctaagtgcttgaatactttcaatggtgctcggtaataattgcttattgcgagccaatagtgtgtcatcaatgtcaaaaactgctaatcttgctaccatattaattgctcctccaagttatcgcgggataaattctgatttaatcaattcatgggtacgggtcttgccgattgccaatcgaaatgctgactgacccaatgattctagatgatggtcgatcgtcgaaaactttaatagtcgactcgtcagcaagttctcctgcccaatcactggaatgggggctaacccgtgatccataaaatattgataggcgcccgccccaatatcatcgccatttgcaaaaatcgcggccacgcgagacgcttgattggtaaaatacttaccagcgtggtaaccgtcttcataagtggcagcaccggtatagagtcgctcgtcatccaactgaccatatacttcgtggtaggctcgccgcgtaacccgtgtactagcactaatgacgttattacggctcaaaataacgcccatcgtcgcataaccttgttgcttcgcccaccgtaatgccgtaacatatgaagccatgcggtccgtataagctgcggccaatgcccggtcatcacctggatcttcacaacagacgatttgaccatacttgcggtaacgttccagtgtatccagtgaactactacgtgacgtaaaaatcagcgcatcataggctttacttcttaagtcttctaaataatggcgttcaatcgtcatatcataattagtcggtagcaacatgattttataacccgccgcaaagcctgcactgacgataccatcaactacccgtgcgaaatacgggtgattcgcatacggtagtaccacgccaattgtcttcgtccgcccccgacttaaatcacgagcgacccggttaggtacgtaatccagttcttgcataatagcctcaactttggcccgtttatcatccgcaacgtacttctgatggttaattacccgcgagactgtcgagacggaataacccgatagtcgcgcaatatcatgtatattcgtcatcacagaacttcctctctcaattgatgataccacgttgtttcatataattaccataatttatgaaaccggtaccaggtcaagctgattttactcagttttatgataatcgtcgcttttttccaatattaaccgtatgatactaactatggaggtcgatgacatgtcaatattaattgccttgcaacaacagtcagactttactagtactgaacagcggatcagtagctatattctggcacatctagatcaaatgccaactattctgatcaaagacctagccgctaagacgtacacatcccattcagcaatcattaggttggcccaaaaattgaactaccggggctttcgcgatttccaacggaaattgactgccgaaagcattgcccaggcacatcaagccgccactgtggatgccaattttccgttctcggcgacagattcggtcgccacaatcagccaaaagatggccgccttgaatattcgggccattcagacagcccagcagcaacttgatacgaaccaattagcccaagctgctgacttattgacgcgatcaaaacgaatctttatcttctcgcaaggtgactcacaactacgggcccgtagttttcaaaataaactcgtcaaaatcaatcgttttgctataatcgccgaagaatatgctgacgaatcctggaacgcagccaacttaacagctgatgattgtgctctgattatttcatatgctggtactactaaaatccatcagcaagttgccacctattttcacgctcatcaaattcccatgattgtcctaacaggtaatccacaatcaccactcatcagtcaagcgacccagcacttgctcaccgttcagagtgaatataattttgccaaaatcggtacttttgcatcccaagcggcgtttgaatacgtcttagacagtcttttcgcagtcatgtatgcacatgattttcatcaccatttacaagacctgcgacaaaaacagcacctaatccaggacggcccgctcaccacaaaataacacatctaacgactcaaaagcgcgtcctacagtttctaggacacgctttttacaatatcttctatttattgtgcagccacgttagcaacgacgcattagcccaattgcaatcccgcgctcgctaacgcttggtcaacaacttccatgaccgcttgggaatgatctaattgccgcttaacggttaccatatcgtgattagcaataagacgttcaaacgccacaaactcagcatacatccgatgctcagcttgattaagcgctaaatcagttgtcgttccatcatgtgcaatttcagtgatactttcgaccgtattagtaggaccgttgacaatgatcgaaccagtcgtcccctgaatcgtggaacgtaccggtgaagtcgaatccttggcaccgatacaaacgactttaacattcggataggtcaacactaagatgcctgatgtatcaatatttcgttcaacattagctaaatactgcacgtgcgttggtgcgcctaacaagccaaccacaaaatgaatattataaatattcaagtccatcagggcgcccccaccaagcttaggattaaaagctggtaagatcgttccggctttaaactgatcataacgtgatgaatactgcgaatagttgcattcgataattttcaagtcgcccaacttggtcaaatcacgtttgattgcctgatagttttccaaatactgattcgtaattgcttcgattaacactaagtcttggcgacctgccaattcgattagttccgttaactgagatgccactaacgtaaacggcttctcacaaatgacgttcttccccgcttgcaatgcccgcttcgcatagtcataatgtaacgaattcggcaaagcgacgtacactgtatcaattgtcgtatcggctagcaaagctgcataatctgtgtagaccgttccaatacgatacgtggcttgcagctcgcgtgctcgcgccacactccgcggcgttgacagcaatcccaccaattcaatcgcgggaatgctcttcactattggcaagaagtcctgaacaatcttgcctgttcctaaaattcctaatcgcatcataatcctcctcataatttatattaacgaattaataccggccaaatgaaaccagctaaggcccactgaaaaaagctcaagtttgcgtaaacatgcttagccagcgtcggcttgcgccgaccgccaacaattggcaccaacctcctaggtcgcacaccggtagccgaacaacaatctaaagctgacacgtaccaatagctgggctagtgcaacacgcaagaagcgctaatgtcggcattgttgaataccagtttctaacattttcacttgcaacaacgtttcctcatctttgactaacttgggttgtccattgatgatgctgtcgtaaacgccggcgtaaacccgactgtagtcaccaacttccgaaacgactgcctcttcgtgatactgacccgcatcgtcgatataagttaacgtgccatagttttcaggttgatcaatgccaaagtcagcgtgattcggcatgtaaaaatgtttcagatcgtattcctgacgatccttagtcgcctttacgaacatgccctttttgccataaaccacgaagctcggccgtgatttaatgcggaaatagctagattttacagagactttcaaggcaccgtaatacaggtcgatatcaaaataatcattcatccggtcacttcccaatagttgccgaacatcatagtgcacgtcatccggctccccgaagtatgcaatcacttggtctaaagtatggcaagcatgaccatataaataactcgtatctaatgaaaaatggtcaacattggttggaacctctggccggaaataatcaaagtgcatttcgacttccagcaagtcaccgaggacgctgctttcaatgaccttttgtgtcgtcaaatagtccgaatcaaagcgccgattctggtaacactgaataaacaaatgcttttgcttagccaattcaaaaagttcgcgggcttccgctgatgtttccgtaaatggtttttccaccaagacattcttaccatggttcaagacatccttagctaccgaatagtgcgtatgactaggtgttgaaacaactacgagctgaatatcagggtcctcataaatatctgctaacgtagtcgtgtaatgcacgcccgcaattggttgccaattctgacgtcctgaacgtgaatagatggtcttcaccttaatttgatctttgagtttcagtgcaaatggtaagtgatagcggttagcactcttaccgttgccgatataagcaattgttaacatcgcgatgtcctccagttaagttgataatttcattatactgacttagaacgtcacgccaagctaatgacatactttaggtcaaaacgttcaataattaacttctaatcggtctttttttaaacattaggtccagccccaaattaatcattgcagataatacttttattcatatgattgcgttaaaattaaactactgattgcgttaaaattaaactactttacaaaatccaggaggaaatttggtttgcaaaccgttttcttagtcttattactcgttgcggctgtcgtcgttgctaacgccgtctacgcacgtttcaatcaaattccagtcgcctttttacaaattggggctgggttaatcttgtctctgattccgttgtatcgaaattttgaattggaacctgaaatttttctattcgtcattatttcgattttaatgtttaatgatggccaaaacaccaatattcgcaagctcagtcaccagtttggcacgaccctttcgctttcggtagtgttagccatcgtgaccatcctaattgttggtacggtcactcacttactgattcccgagttttcgctggcacttgcttttgcccttggcgctattattacgccaaccgatgccgtcgcggtctcatcgattacgactaaagttgcgattccaagagcagtcatgacgacgcttgaaaatgaatcactgttcaatgacgcctccggaatcgtggcctttaacttagcgattgctgcgatcgtcactggtaagttttcagtctggcacggaatcactaactttttatatgtctttgccggtggaatcttcgtcggcctaatcatcggttatgtcattgttgctgtcaggattatgctgattcgcatgcgggtcgatacaccttctgtgatcgtcccctacacattactgacaccgtttgtcgtctatttcttagctgaatcattaggcgtttccggtatcttggctgttgttgccaccggtctcattcatggtgtccagtccgatcaattacggttgaccacttcccggctacaaatcgtgatgacaacgacttggtcaatcgtggctagtattttgaacggtatcgtctttgtgttattaggtgtgtcgttgccaagtgtcatcaaccacttacagcaacgtgatactagttcggtcgcggtattagtcggtctgggaatcttgctctacctaatcatgacgttcgcccgttttctctggacgcgcttcgacttagcccgtattcgcgcgtgggataatcatgaaaagacccgtaatgcattcgtgatgggtctgagcggcgttcacggcacgattacgctggcgatggctttttcattaccactaacactcaacggcagtgcttttccttatcgcaacgatattattttcgttgccgcagtggtcattctaactagtctgctggtgccaacacttttgttaccgttgacgttgccaaaacaagttgttaaggtcactgaagatgaattggcaaccgccaaagctgacatggtaactcacgctattgatctcatgcaagcacgccatggtaataatgctggcactagtaaagtgattgcgattctgtccggccaacgagtactagatggtcgtcctaagcgctcgcaactggcgagcttgttcgacgccactttcaaagttgaacaaaccactattgatgaaatggttgccaacaatgaaatcacgccccatgccgccgaaaagtacatgcgcgtcgctagtcagacgcgtctgcagaatcaacaaactttcttcgaacgtttgaaattatttttccggtttacactcagcaaatggtcgctcagcaaaaaagctcgtgcccgacgtaaaatgttccgacaataccggccccgtggtggtcagagtcgaactgagctcatgactcgtaatcggcaaatgtggcaacaaatgcgacagatcgaacaaaagccgtatgaggccgtgttagcttatttagccgacacgattactgctgacaatcagcaagctatcgggatcgttcgccgcgcctatgatgaacgtcatcgccgcctatctggtgaacgggatttccaggaaactcaaaatgagcttctaattgaagcattccagttggaatataacttcattcagacccaattagccaataaaacattcagctcagaacttggtaaccaactctatgaacaaatttcaactgatcagttagtttacttgcaatcgatcaataccgactaaattcgtttagtaatgtcaataacgtgaccaactgtccacaccactatttgggcatcgggtccgttacactaacgttgtaccattggtcgaactgccaactgaacgtctcaacaagcccccccaatcttgtgaccatggtaacctaatgacgcctgacaacttgtcggcgtcattttttatgatatttttgaaacaaaacacttgtcttagagtggctctaaggtgctaatctataaaagtattcatgaatgagaaagtgagcgatagataatggaaacaccgattttagcacgcattgatcagccggccgatctgaaacaattatccttgccggaattaacacaactcgcaagcgagttacgtcacgtcctactcaataaagttagtcaaactggtggtcacgttggccctaacttgggcgtagtcgaattaaccattgcctttcacaccatttttaattcaccagttgataaggttgtatgggatgtttcacaccaatcctacacacacaagattctaacgggccgaaagcaagcttggcttgaccccgctcattataatgatgtcagcggctacactgccccagaagaaagcccccacgactatttcaatattggtcatacttcaacctcgattgccttggcaactggcatggctgttgctcgtgaccttgagggcaaaacaggcaatgtcatggcagtgattggtgacggctcattatccggtggtttagcattggaaggtctaaacatcgcggccaccttaaagtctaacctcattattctggttaacgataatggcatggcaattgcagaagaccatggtggcatttaccaaaatctccgtgaactccgcgaaactaacggcacaagttcccataacttgttcaaagattttggcctcgattatcgctacgttgatgatggtaacgaccttgagaccatgctaacgacttttaaggaaattaaggatgttgaccacccaatcgtgttgcacgtccataccgaaaagggtcacggctatcaacccgcgatcactaataaagaagctttccactggcacgtgccgtttgacctagcgaccggtcagacgttgcatcccaacaccaaggaaacgtatacggatgtcattcatgccacgttaaccgatgagttggcagccaagacgcctatcacggcaattacggcggctgttccaggaacttatgacctcaaacgctttgctcgccaatatccagaccggtactttgacgtcggcattgccgaacaagaatcgattacatttgctgccggacaggcccaacaaggcttacggccaatcgtcttccattctggtaccttcttgcaacgggcctatgatcaactatcccatgatcttggcatcaataaattgcccgttacgatcatggttgccggtggccgcattaacgcaggcgatccaactcatcaaggtatctttgacgttgccatgctcagtaatattcctaacttaacttacttagcgccaacgaccaaggaagaacttcaagccatgatgcactgggctctccatcaaaataacggtccggttgccatccgggtaccaagtaatgacgtccagtcagtacctctagcgcctgattttgacgcaactaagatgcacacattacacgctggtcagcaagttgctttactcggtgtaggcagtctcctgcctttagcaacagccgtgcaacaacaattagctgagcaacacattgacgcgacgctcattgatccccgggacatttctgaccccgatacgacgactttggccaacttaaaggccgaccatcagttagttgtcacggttgaggaagccagtctcagcggtggttttggtgaaaaagtcagtcgctactatggcaacagcgctatgcacgttctgaactttggtgctgccaaacgctttaatgaccgtgaaacaactaatgaactgcggcatgaatttaagctgacccctgaccaaattgtcacggcaattactgatcaactagcagaataatcatcaggccagcgactcaactttcgtttacccatcaaaagtctaaccagcatgttgtcgaactcaacacgctggctagactttttatatttaactgacaataacccaatctcagtttaacgattgggaaaacaggacggcggctactgtgccaatttggggcaaaaatcagcaattagcaaacagaacgccggctaataagtcgccattcgcaattatttatattaacgcccaatacctggcgccttggtcggccacaaaatattattaatattttattgttcagaaaagactttcagcaagctgctgtccttatagctccaaatctcattaatataattatttagtcaatccaacgctagttaaacaattgacagtcccatcagagttgtttacagtaaaaccaatctcaaacctaatattggaggcctttattatggcaagtcaccaagccttactgattattgattatacgaatgattttgtggctgacggcggggcactcacttgtgggcaacctggccaagcgctcgcaccaacgatcgtcaaactcgccaaccaaatggctacggcaagcgactgggtcttactgccaaccgatgtccataccccgcatgatccttaccatcccgaaagcaagttgtttccacctcataatgttcggggtacctggggtcgtgaactctatgggccactcaaagattggtacgctgatcatcaagccgccgataatgtttgggcattcgacaagacgcgttacagttcatttgcgggtactgatttggatttacgtctgcgagaacgccatgttgacaccctgcacttagtcggtgtttgtaccgacatttgtgtccttcacacggctgttgacgcctataatttgggttaccaactcgtcattcatcaggatgccgttgctagttttgacgccgctggtcacgaatgggcgttgcgtcacttcaaaaacagcttaggtgcaaccatcgtttaaaaaatgcgcaataaaaatcactcatccaatacgaatgagtgattttttaggattactaaattaattcaaggttggctcaacccatttttgcaacatcaaggtattcaacacaccttcaactaagataactgccaacatgacgagactaccgacccataaagaatcgatttgtccctggttgactagctgactggagagaaagctgaccatgctaatcaacaaattagctaagcggaaagccacgtaaatgaccaccaccgtgataattacattgacgaaccgttgccgaaatcgtggtaaaaagcccttggtcgcattcgtaacaaaatggcaaagcgttatcgtgctccaaatcagaatcgtcacaagaactaagactagcaacgttccgagtgcgaactgcacggcactacccgcatcaaactggctaaagaacagcgacgctgatgttaagcctcccatcagttcattccaaccaatccacagagttaagcagaataaaatcacttgggccaaccaaacataaacaatattaaccaacgaaacgactaaattaatcgtatagcgtcgccaatcgctaattggcaataaccagaacgtccccgcccggaagaatttttcatttgaaactgccaataagataaacccaacgattaaaggtaacgccatccaagcacataaattatagaataatgtggcagctgtgaagtttcctttgatggcagtccacaaactagtaacaatcaccgccaaagcttcgataccaatcaataaactcatttgcttaaagcgtggccaactgagggccttaaatagtgaccaactacttgtcatccgtcacacctcccatatataagctctcataataatcttcaagttccatgccatgttcgtcgcgaatctcatctgcaccctgatgaacaacaattgtttggtccttaacgaccacgatttcatcaagaatcggcgcgatttcagtgacataatgatcactaatcaataatgtcgcttcggcaggcgtccacttgataatactgttaataatttttttgcggctcatactgtcgatcccactaaacggttcatctaataagtacaaagccactttgcgactcagggtcagcgcaatgattaatttctcgcgggtccccttagacaactcacccaatttttgttgttggttgagttccagaaagtcaaccagctcttgatagcgtttggcgtcaaaatcaggataaacaagttgataaaattgcgcgatttgttgtaatttcataccggcactaaaaccagtcaaatgatccgtgaaacttacctgctgcttacgggctacggcagttgtcgcgccattgatcacaatactgccctgacccttggcactacccgtaattagtcgcatcaaggtcgttttacccgccccgttttcacctaataaaccgacaatcttgctgggcgccagggttaattgaacattttgtaaaatcattcgttgattatgtttataacgtaaatccttaatcgtcaatgctgtcatgattgtgctcctctcgttgggcaatgtattgttgcagactcgccacgatttcggcgtcacttaaatttagtgcgtgcaattggtcgtacgctaatgctaattgctcgttcaccagtgtagtcctcaattgcataatatgcgcctgatcttccgttacgaaattccccttacctcgttgggacgtcagagtgccttccgtaatcatctcactgagtgcccgctgaactgtattaacattaaccgtcaagtccaacgcaagctgccggactgcgggcaactttgcccctggtggtaacgttccgtcaatcattttatgataaatatactgtttgatttgataataaatcggaaccttgtcatcaaatttcaatttaacggcctccttagtgttctatttttctattacaatataacacagctgataccaaaagtacaataatgacctaccgttacttgtgatagcggttacatttgtaacttgaatctcaatttaggagcgctatacttaaattaggacgtggactaagttcgccacatcacaggagagggatggtagcatgttaaaaaacgaaaacgctattgcgctaattcgcgccatcgatgtcgcttatagtgaccccgaagtacgcgcaattcccgaattacaacaagccttagctaaggccgcacaagacttagactgtgttgcggaccaccatcaagttgctagccgcctaaaccagttgctaactacttggggggctcgtcattcacaaggccccgccgtacttgaccagttatacctgatcacactcaaagatggcgtcgatgtaccttgccaggtcccataccgggcataattatcttaatatcacaaaagctcccagatcgaatcgatttgggagcttttgtgatattaagaggccgtttgtttgattcctgttcgtcagcaatgatcgtccgattccgacctccggggctgggtgacaattgctggaacgtaagccgacgtcgatttgagcccgtgcacaacccgcccggtctcaaatacgagtcttattctaagccgaaagcaccccacttccgactaagaataatttggctactgagcattgtcacccagcgcctccagtcggtaagccgctcgaatggctgatgaacggccactgaactcggtacaatttgtcgttggctattttggcaaaggaacctccaacgaaaatttaaggttacagcaaccgctttgtctagacggtcaattattactatgttgattgaggaatagggcgctatcacaatatcaccttcagcctgacagttgattgagaaaattactgtttatgaaaagtaacgacaaatcgatcaaaagttgagtacatctctatcagccattcgaatactctcccgactggaaggcgcttctgacaatgcccagtggtgaaatttcacttagcaagcgtcttgtgcttggttagtgaaaggtcagtatttgagacgtggtttttcggctcaaatctgtgcccaccacgttccggcaattggcagaaatgcctggaagtcggcgtaggacgaactaactaagcaaggttacgctaactcgcactttttccagtggtccatagctggctgcttttgtccttgaaagttagcatcctaatatcacgattcatgacaaatcagtgctaattcaagcaagctaacattactgcacgtattgttccaagaatgcggcgacgtgacgcttgtaacgttggtaattctgagtaatggccgtggtgtggccggctcccttcaccaaccataaagacttgggttggtgagcattgcggtacagcgtcttgcccatgctagtcgggacaaaatcatcccgggtgccgctgataatcatgataggcaagtggtttttacgaatctgagcgattgcatccgcctctttgaagctataaccagcacgtaatttagtaatgagactggttacgttgactaacggaaacgcgggtaaatgatagagttgccccgcttgataactaataatcgcatcagcactcgtaaacggactatcgacgacgtacgctttgatctgtggcaactgccgttcaccactggccatcgtcatcccggctgcacccatactgataccgctcatcacgatttgagttgtggccgttttatgtacgacggttttggcccactgcaagtcgtcgcggcgctccagccagccgtagccgaccgcttttccctggctcgcaccacttgctcgggaatcaggaaccagcacgttgtagccgagttcatgatacatccccgcccacgcacccatcaaacccttattcccagcaaatccgtgtgccaaaacaacagtcctcttagaatttttaactggaatataccaagcaaccaaccgtaaatgatccgatgactcaatagtccaagtttgcttacgcgcatgtaaataccaatacttttggtgataaaccgaactttttttcgatagctttgtactctgcgtaacaaatgacttatcaccacgggcaattgccacgtggtaaaaataactgccagcaccaatcacagctcccgctaccagaacaacgagtacccccagtgtgatccaccatttcttcattaaaattcactccttgatgagacaaaaatctgttttgagcgggaaaatttcgccactacttcataataaccgttataattaaagataactagaccagattgaggaggcttctttttatgcactattccgaaacgtgggatttggacagtatctttgctggtggcattgattccccagcactaactgcaaaaatgtccacgattaaacagcagttgaccacgacagcagacaccttagttcactggcgtgctgccgctgacacaccagacgccgactggtttacccaactcgtcaacagtctgcaagccattcaagccggtattgaccaagctaccgttttcgtggttgcttatcaatccgcacatgcggacgacaccaaagccgccccactattgaaccaaatttatcaacttgataatcagttaaacaatttattaacccgcttcaagaagcagctcgttaagttagatcaagccacctttgacacgctcgtgcaacaaccggcactacaagccatcgcctttaacttaaccgaaatgcgtcagcaaggcttagcgctcctagatgacgacactgaagccctaatcaatgacttagcactcgacggttttcagggttggagtgaccactacgacacgttagttagccaaattcaagtgccctataccgatgaaaacggaataacccagcaactatccgcgggtcaagctcaaaacatgttagcagccgccatgccgaacgctcaacgcgccgaattaatgcgcaactgggagcacgcttggcaaactcacgccgctccctttgctgatacgttgaaccacttggcgggcttccgacttgccaattatcgtgcgcatggtacgacgaacttcctacaaaaaccactagaactcaaccgcatgagtcaagcgacactagacacaatgtaccaagttgtcgctgacagcaaggacattttactaagttacctgaagcgtaaggcccagttactcggtaaagatcaactagattggcaagatattgaagccccactaaccttgggacaacttcctaaccaaacttacgatcaagctgccgattttgtcattaacaactttcgccaatttagtccaaagatgggcgctttagcccaacacgcccttgaacatcgttgggttgaagctgagaatcgccctaataagcggcctggtggctatatggaaaatctaccagagacccacgaatcccgaattttcatgatgtttacgggttcacctaatgacacagccaccctcgcccacgaattagggcacgcctttcatggcagcgtcattcaagatctgccactttggcgtcaagattacgcgatgaacgtggccgaaaccgcctcaacattcgccgaactgattgtcgctgacgccagtgtcaaagcggccgatgatgccaaaaccaaattaactttattggatgctaaaatgcaaaatccgttagccatgtttctggatattcgagctcgcttcctgtttgagacgcgcttctataccgcccgtcagcacgggatcgtcactcctgatactttgtcagacttgatgctaaccgcccaaaaagacgcctatggtaatgccttaaatacttaccacccgatgttttgggctagcaagttgcacttttacattgacgacgtcccgttttataactttccatacacatttggctaccttttcagtctcggtatctatgctcaagctaaaacacaatcggactttgaagaccgctacattgccctattgcgagacaccgccaacatgtcgaccgaagccctagctgccaaacacctcggtgttgatctgaccaaaccagccttctggcaagctggtgtagctttgatcaagcgggacatcgatgaattcatggcgttatccgcaccgttaatctaaggaatggaagtgagcacatgtttccagaacgtttaagagcactacgtcgggggcaaaaaatgaccctcgctcaactcgcggcggccctcaatcaaatgccgaccgcagacaagacgactcgtcaaaataccgcggctcaaatcggtaactgggagcgggacttacggaccccgtcctacctagaagttcgtaaattagccgaatttttcaacgtcacgaccgattacttgtcaggtaaatcagaccaagaagagtatgacctcggtcgcatctttttatcgggcaagccgttgacgtttaatcaagaacaattatccagtgaagaccgctatgaactgtttcagttgatggatggttacttacatggtcgccagcatcgagtttcaacggatgcgaccggccaagaagaattagacttacactttgatgactaggagttttttatgaatcccaagaagttaaaacaattaaaaaagcgggtcaaaaagcaagccggtgccccgtatattcaacagttaatgaagtaccgcgacttatttaaggatgatccccaaattctagtgctgatcaataatgtcttggaaagtgaccgcttgctggcagccggcttagctccccaacaattgccattcttagaaatccctgatgattttcaggaccatctctttgagcgcatcaatcagcaatatgccatgggtgatcctgctggtgatgcggcttggaaccaactatcagccgctctcccaaaagttgaccaacttctacgcaactttcgagactatatcgaagatcagtatgggatgtgggcctacatcagtgcgccatttctgaaagacctagctgacttcaccggcagcgcaccagttctggaagtcatggccggtaacggctatatttccaagggcctcaaacgtctccatcctggtcagccaatttataccacggattcaaaggattggacacacgaaactggcaatcagacgggacgccacccagtcacgacgattgaagcgttggatgccgtcagtgccttcaataagtacgccgcaactattaaatacgtcattatggcctggtcaccggacaaattgactattgattgggacttgttacaagctatgcggcaaagtccttacgatatcccattgatcgtcattggcgaaaaatacggcgccacgggttccaaacaattttgggaccacgctaattatcaggataacgaggccgttaccaagttaaatgctcatttccgaccattcgacctgattcacgaccacgtctatgtggtccgataattgaacacgcgttaaattaaagtcgtgctttcaggattaaattctgagagcacgacttttaatttttccgtcatagctgaatctcttttttgccaaattcattcgtgatttgcttaaatcttagcatcacattttcaattgttgcagttgttccaatcccgccaccaacgatgttcgtgaaattcccccggcagcgagactttggtcgtcaaattgattaagcgtcgcataaagccaaattccgagctgcaagaattcagcttccgtcattgcgaactgcaacgctaacaaccgctgagcggcttgagcataagcctttctgtcaatgagttgtgccaattcgacttgatgtggcaacggctgatcttgatcttgcggaaacaccacctcagttgtgcctcccttatgacgactaagcgtgtaccctaaccccgttgcgaacgcatgtaactgccgcattaaccaatcactttcatcttgcattaacattaatccccctaattgtgtgccatccaataaatcgctaaaattgtcaaaatgactgataacgtacacatgtaccagtaaaattgtttttccggtactgttcgaccatgctttccctgataggcatccgccatactagtgataaacgtcgccaaaattgtatataagatcaataacgtaaacgcgtaggccgtccaagccgtccccatcggttggtgcattgcttgcaagccccagccaatcaaccatcccaccaataaaagacccgtaggcgctgcaattaaccgtcgcttcatcctcatcactccccctagaattagcttcattatccgcttttaaaactcccagaccaagcagaatgacgccctaaaattatatccgcataataccaagccttttctgcacgaaatattgttaaaaggttccggttaactcgattcctgttcgtcagccggtgcgcgtcctatgccgacctccggggctgggtgacaattgctggaacgcagccgacgtcgatttgagctaacgcccaacccgcgtcatctcaaatacgagtcttattctaagccggaagcaacccacttccgactaagaataatttggctactgagcattgtcacccagcccctccagtcgggaagccgctcgaatggctgatgaacagccacttaacttggtacaattagtcgctgactattttttattggaacttttagtgaaatatcaatgtgtattctctactttgtcgaaatattcaactattactacggtaattcagaaatggtaagttatcacaatagcatcttcaacctgacagttaattgacaaattactgtttgtaaaaaacaatgacaagtccagcaaaagttcggaacgcacgtgtcagccattcgaacactgtcccgactggaaggcgtttcggtcaatgctcagcggtgaaattccactcagcaagcgtccttggcttggttagtggaagaccagtatttaagacgtgggttgcggcttaaatctgtgtccaccgcgttccagcaattgacggaaatgcctggaagtcggcgtaggacgcgtttaaccaagcatgtttacgctgattcgaactttttccagcgggcctagctggttacttttgatcttaaaccggaaccttttaacaatcattcctgacctatcctagaacgaaaaagcctgcaatcaattgattgcaggctcgttcacactgactattcgacgttgaactccttgaaataactggttagtggtttcaattcgttcgcgtcatatttttctttgaaggcactgacagaagcatccgatgtcttggctggatcaacatcaaggatttcaactggtaacccccgtttgtccgtaatcttggcatccattaggaccggacgaccagcctttaattcggtcatcgcagtttcgaaggctgcgtgcagttgatcaaaatgttcaacacggatacctttgacgcccattccttcagctatcttagcaaaatcagcatcaatcaagtcgataccataatatggttgcggcacatcttcttgttctgatttaataaagttcaacgtttggttagacgtgacaatattaaagattggcaagtgatacttaacttcggtcaataagtcttgcatgaccattgagaaggccccgtcgccagcaatgttgaaggcttgccgatcaggataactcatcttcgccgcaatcgcaccgggaacaccggcacccatcgtggcaaatagtgctgaagtcaataatttttgcttgggattcatctttaggaaacggaaactattaatcgtattgtcgccaacatccattgagaaaactgcatcatcggcagcgacccggttgatttcttggtagacttgttcgtattcaagtggatcgatcgtccgttcactcagcttcttcaaatactgtttccagtcagccatatctgctttagccgcttggtagtatggcgacggtgacgctggttcacttaatgccaaggcccgtttgatgaagactttagcatcgccattaaccccgaaatccaaatgatggtgccgaccaaacttgccaggatccagttcaatttgcacatatttgaagtcgtgagtcgtgtacataatctgtgcgaacgaataatccgcgccaactgaaacgaccaaatcggtaatccccatcagttcatccgccgctttcgaggctgcccgataagcgcttcccatattaccatcaaagctatcaggaatgacgcccttggctaacccagtgataataatcggtacttgcagacgctccgctaacgccatcatgtcctcggttgcaccacgcgtcccttgaccaacgtggaagacggggtacttggcgttcttgatcatcgttaacaccgtcttaacttgttcatcatcaatagtaggaatgccggtcagtttagcaggaacacttgctgaatcgtaattaagatcaggaatttcaacatatccaaaatcattaggaattgtcaccaccgcaaccccattttcacgataagccgtccgaatggccttatcgacgacgtatggtaagctttctggtgtcatgacggttcgattaaagaccgccacatcactaaaaatcggttcttcagcgaattcttggaaataatcatagttcatattagtatgagcaacttggcccaccaaggcaagtacgggcacgtgatcttccttagcatcatacaacccgttgagtaaattaacggcaccaggaccggccgacccaaaggcgaccccgattttacccgtcaactttgcatccgctgccgcagcgagggcccccacttgttcgtgacgtacctgcacatattggagccgttcttgctcaacatccaacgcgtgcatggttgagttaaacgatccaccagcatagccgtaaatctgtttaacatcccaagcttcaataacttttaacattgcaacagacgcttcaatcatctttgccatagtaaatgccttctttttaaaattattgtatacgttttcatttacgattatcagaatacatctaaattgctcaaaattcaattgtaaacaatcattattttataaatattttcttaactaaccaaattcgatgacctgacactggtccgaaatcgtgttagcctgccgttgttctggaaaatattgaacgcttatccatcggcttaatctaaccaatcagcaaggtgaaataatgatgaaagataaagcaattaatattctgactgccgaactgtcagcactccccgttttaataatgacgtactatgcgcttaccgcgaaaccgactggacagtggcagctgacctttagtctccccgtttattggctgatcagttccgacctgttggcctatccctggctcctcacccggattccctgcttgcgccacaacccccttaaaatgaattcactggcttaaaggcaagctcaagatacaactgccggctcaacgaacgggtcgcgcgctgggatgatgagatgaatctcgcgattttcttactggaacgcggttgtctaatgttactgtcagaaccactacttttaggcgatttaggctatcatagtgtccgacggttatggtattgatggcaataaaaagcatccatgctgttcagttttatgaacagtgtgggtgctgtgtgcattatttaagaatgttggtctccaagaaggcgacagcagcttcttgaatcttgtgaggtacgtggtgaacgccaccttcagcgcgtttaaagacagttgccttcagggctggctcatctttaaaacggtgcttaaaatcacgcatatactgataaggtaccatttgatcggccgtaccgttgaaaaagaacattggtcgtcccgccagtgcttctgggtgttcagataagtcaaactttgccaattgttgataagtttgttcaattagttctgctgggagcttagcttgtaatgccgctggtaattgtgcaacttgatcggttgcaaaggccaccggttctggtgaaccaattaacgagacaccagcaactaccgtgggctgcgttgccataataccggcagcggtaatgccgcccatcgaagttcccatgacaccgattttattagcatcactaattccagcagccactaaggccgcgactaattgtggaaattccgcaactgaatgtccaacaatcgaccaaaaatgttcaggatgccgatcgagatcagtcccatcatttcgactgccatgtaaatacgctgtcgggagaatgactcgaaaacccgcgcgtactaactgataagccgtacccagttcagtcgctgtctgatttgtccaaccatgataatcgatgatcgttggtaatttagtttgtgcttgactagctgcaaacacgtgtaatacgggcaaatcaccaaatttggtcgtccgcaccaccacatcttcaaataaatttgttgtcatgtttatcaccgtttccaaaattaatagttaatagtgtagcagaagcccaaacgaaaaccaacccaaacgcgtccatcgtggttaaagcttaaccatcatggacgcactcgagttggctcgttttaacacggttagttatcagctagcgtcatgcctttcaaaactacttttcaagtgtatctaagaaatcttcaacttgcttttgggtcttacggaatttgtcaacatatcgaccaatttcttgaccatcttcgatcccaacgaaactaggaatccccatcacacccatgtcttgggcaatttcaatgttggcgtcacgatcaaccgtgatccagtcatattgatcgtacttcgcttcgatttggggcattactggtttaataaaagcgcaatccgggcaccagtccgccgtaaagaataacatgtgtttacccgtcttgatacgttcgcgaatttcttcgtcgcttaaagttgcagttgccatgaaaaatgcctccaatatctttataataattatagtttaccacatactaaaagtaagtaaagtcttttgctttattttgttgctcggatcagcgcttgcttgagatccgctgctaaatcggcactattttcgatcccaacggatagccgcaataagttagcggtgatcccctttgattgtcgttgctcttccgttaaatctgcgtgtgtctgaactgccggaactgttaacaggctctcgacaccgccaagactttccgcaaacgagattacgttcaatgctcgtaaaaaggtatcgacgtcggtacccgtagcgagataaaaactaatcattccaccacgtcctggatataagacacgttcaacgtgttcatctgcctcaaggaccgtaacgagttcctgcgcattagcctcctgctgatgcaaacgtaatggcaaagtcttcaagctccgtaagagcagccaagcgtcgaacgggtcaaggaccgcaccagtcgtcaccagattaaattcaagcgcatcagcatccgcctgcgacttgactaccactgcaccggctaaaacatcattatgaccggctaaatacttagttgcggaatgaacgacgatgtctgcgcctagatccagtggcttttgaatcaacggtgtatagaaagtattatcaacgattaacttgaggtcatgggcgtgtgcggtagccgctgtggccgtaatatctatgaccttcatggttggattcgatggcgtttccaaccacagggcaacggtttgatcgtctgccagtgctgccaatgtcgcttgatcctgcccatcccagacagcaaaatccaaatgataatggtcgtgtaagaggtcaaagaagcggtacgaacccccgtataagtcatcagacacaataattttgtcaccactattgaaaagcgtgaaaacgagctggattgccgccatgccagaagtcagcgcatacgcagcgatgccgtgttccatctctgccagcactcgttccaaaatacagcgggtcggttgggcctcgcgcgggtagtcaaatcccgtagattgtcctaaaccagcatgtcgatatgctgtcgacaagtagatgggcgccgaaattgccccggtcttctcatcatcactccgattaccagcttgtgctaaccgcgtttcaatgtgtaatttctcagcttgttttgtcataatctcaatcccatccaatctagttatggtcgggcagtctacagagaggccagtgtaaaaatgactacaaaaaaagccgccatcttcaagggacgccggtcgcgtgttaccacccaagttcaattacgggtcaccccgttaaactcatcaagtcattattgactcactggagtatcggccagtcccgccagtacagccttgcgaccgcaactgggcattccgagttcatcttcatcaggcgctaccttaccgctttacactccccacggctccctgtcaaaggtataacctgactactcttctcatcaacatgttatttaatgatattttcatcttactctcataataataggagcgcaagccccaatcttatttcagcacaataaaaaatggtgccagcattatcctgaccaccatttttacagaaacgcattcgacactgcctagctatcccaataatttcaagacaatcacaaaatatcctaaaatcaaaatactcaaccccagcgtcttcaagagggctaaccactggccccctgcagttcgacctttagggcccagacaaatcgcaacgccgccacaaatcacggccaaggttcctagctcacggccccagtttgcattcaataagtaaatgaacggtcccactaagccgctgacaatcgcgacgatccccagtattttcagaatcaagcggcccagtcgcttatcctgttcgtcataaatttcatgtttctcttttgccatcaaaccagccaccaatctttatgaactactttcagtatgccgtatttggtcacaatgagcaagaaggcggttacaatatcctggtcaaattactgaggcatcactaggctagcttgtcataccttaccttgggccctgccggcacttacccgtgataacagctgaatcaagctaccaaattgaccatgatgatactaaaaattaggtgttcaaaattgacacccgctgaacacccaattggcaataactatttttcaattgtaacctgctaaacgacgccattatggctgtgttgcaacaacttgccatacgttccccttagccaactgctgttgttccaattgaccttgggcgttaatccgaaaacgacccgctaagtgtgcgacatcggcgttggtattttcataaacttccacgtaaactaaaccaccgctttgatactgattaaacacaaagttttgcttattggcggttgtttgttgatagtccttagccacttgttgccaagcccaatcattaatctgactagctgttaactgctgtggattggtcgtttgctggccgctagttgatgatgaggtcgcggatgcagactgcccggtagttgtttgactagttgcagtggtatttgaatgtccctgcgagctagctgcagtagctgtcttactaccctgactagtcgttgcactagcttcggattgtgactcattagctgaagttgtggaaactgacgatgctttagttgacgacgatttagcagctgtcgattgcttcgtcgactttgctgaagatgacgcgtcttttttagccttagtctttgacacaactgattgtgtttcactaacccgcgactgactagactgatggtcggcttctaagtaataaccgcctcccagcgcaatgatcccagcaatcacggctgaactaactaacatttttttcaagataatcaactccccaaagattaattgtctgatgctaactacagcatacgctatgttgtctcactttaccaacgtttacctgttctggatcgaaatttaactttaaattatatttggctcagttggtccatttttgggcacctaagattcattgtgccatccttttcttgactacgtatctcctcaacaacaaccgtggcatcagcagaaatgaattttgttaacttgaaagctgtttccacaaccttatttctttaaagttcattttgccatcatactgccccttataagtatatcgtaaatgacacccgactacggcccaaaacaggctaacaatgtaaccgtttcataatttgtcatcaaattgttacttatgtgaggcccccttcgcatgctatagtaatcaaccgatacaaaaaaactaggagtgtgtgaatagaatgccacgtaatttaaaagaagaagttgtctttaccgccattatggccggtttaatggtctttgtgatgaccgcctataacgttacccttgctcaaggtttcagcaacgggttagtaatggcaatccttagtggctacccactcggtttattcgttgccatcattttagacttattggtcgtgggaccaattgccaaacgattagctttcaaatatatcattaatgattacatgcgcaaacgggttgtcttgattgggattaccatctccgtcttgatggttcttggcatggtaacttgcatgtccctcttcgggattgcagtggaaggtgaattgtccggaagtcacgttttagcgacttacggtcacacttggatctttaacttgattgttgcattaccactccaactcatcatcgtcggcccaatcgcccgcggtgtgcttggaaaaatgcaacgggcaactgctaacaccgagtcagcagctgcaatgaacgaagaggactaatctttcagtccattgacggacggtcgccgggataatcttatcctgatggccgtccgttttattttacgactatccagtcgaccaccgcttttgccgaatagtccaccctatgaaagtcttatgcgtgatctgtacgcaaaaaaaacgcgtgtcagccatccgaaaatggttaacacgcgttcatcgcggcactggtaaaaccagcgggagtgacactccacaatgtcagtgacccagacactctgaaatacgtcagagaaacgtgccccgctatcaatattagtcactagccgctcgcgcggaaccgttattgctaacgatctgactctatcgactcatcgcatggactaccatatcatcttcattgataaaatgcaagtcgcaccgccacaaaattcgtggctcctactcaccacagttgggccgcagtacttaacttttcgcaaccaaaaaaattgagtatcccgttcgatttaatgaacgacacactcaattccattggtattttgattttggcttggctccaatatcaattcttaccttaccatagtcatgtaaagatttagtaattaactcgtaaagattacgtttaagcttccgccgccgtgatctggtctaagcgatcagtctgagccgtcagccaatcggttaataacttttcagcgttggcttgatcagcgagcacgtcggcaacgcttcccagctcatcaattcgcaatcctgacggtaacgcatcggattctgcaatcatgtaaacgttgattggcagcgtatcctctgccgccgtaacctttccaatttcggtcagattagccagtggcaaattaataacactcgtctccaaccgaaagctgatagctggctcatgcttagccgtcagcgtcacttgggcaagctggtcggcattgagtgccgctaccagcttcgccagccaaggcttaaccttggtcgctagtttggcataggtaccagtcaagctatcctgcgtaaccttgtcagccgtaacatcatcaataaaagcttgtacgtttcgttgcataaaacattatccctcattcattattcaatttcgttaatttgcacgtcgccagcgagtcagtaacaccaacgtataaaagttgattcccaatccaatcacacccataacttctaacgccagtttaatttccatgccagccgtactctgatagcccgacattaaggcgctgacaagtcctaagctatatatcagtacaactaaccctaggacgtaaaaacccagcatacgattaatatacactgctagaacgcctagaaaatataagactagggcaatcagcaacccctgccacatttccgctaccgaaatattttttgcctgcaggtgaaaatggctagtcgacatcatccaattgacgataccgtaacaaaaaaaggacacaaacgcaaatgcaactaagcgagtcagtttcaacaaatcactcctattattgggcaattaagtcaataacggctgaccgttcaattcccgtgaagtactgatttaaatcaatatctgccagcgctttagcgatggcctcatggtcgtaccgcacacctttaagggcggcttcaatatcttgaacgttgccactaccaaagaaatcaccataaaatttaatgttattgatcaagccgtcatcaaccgagatccgcgcatcaatggttcccatatcaaagtgttgacgccgcttaaccgagaattccggtgatttaccgtaaacccaatcccaattagcataatagtcttcgtaaattttatcaatagctttttgttgttcaggtgtcacgtgatattccttatccgcaatctgatccaacgaatcaacatggaacaactcttttaacagggcatcctgaaattctggcaccgtgatattctgatattctggcgctaaataaggccgtaaattcgtgacccgactccgaacggacttaatacctttggaagcaatcttgtcggtcgggactgttagcgcctgtgggacaacgtttaaatcaacattcaacatcaaagtgccatgggagaacgtcttgccattccgtgaatacatggcgttaccggagaatttcttaccatcaacgagcaaatcattgcgaccactgaccgtcgctgtcgtcgcccccatatcgtgaagcgcatcaatgattggcttggtaaatgtcttaaagtcgccaaactcttgactgtcactatccaccacaaagctgaagcagaggttaccaagatcttgatacacagccccaccaccagagagacgccgcgttacggtaatgtgatgttcccggacatagtcagcattaatttcttcaagggtgttctggttccgaccaacaatgatgcacggttcttcatagtagaacaaaactaatggttcatcgaaatccacgttattcattaaatattgttcggttgccaagttacggccaatctcatgatctttcattgcgacataatacatgttttaaaatctccttcagctttaggttactttaatcatacagcaagatgaaaaaaggacccacaatgtgagcccattttttggaagaatcatacaaaaagtttggcgtggcattcttcacaccacaagatgactgattcactatccacatccgtgaacgtttgattggcggcaatccgttctccgtggacataaccgtgccatcaatagatggaggttgggccagtcagttatccgaaattagcggaaacgctgctatactgcactagctatcacttgacgggtttgttacaacaattgggtaacagtttgatactgacctgtgactcttccgataaatccaatatagcatacaatgtaagcgattgcaaaccgagtaaaaaaacaacctagtcagccgaagccaactaggttgccgaaacattaatagcggtcgtaatcgctattccatttcaatatccttagtataaagccatttggacgccggaacaactaatatgcctagccttcaagcttagcaacatagtgcgttgcaccggagcgactcagatatcggagccacgtgtaaccctcagcttgaaccgtcccattgtaataaaccgtttcacctgggttatattcaccgacaacgcttgcgcgcgtacttggcgccgtacgaatattagtcgtcgttacgaagcggaacgccccttgactgtttgttaccggcttagacgtcgtatttccggtagcggcattaccactaatcgctacgtaatgttgggcgcccgaataagacaaataccgtaaccaagtctggccgttagccgttaccttagcgttgtagtagactgtatcaccagcactataggtaccgacacttggggcatttccggccggtgtattcttaatcgccgttgtttgcataaagcgataactaccactttgaggcgttacttgcggtttatcaacattggtcgacgtactctcaccactaatttgcacataatgctgggcacctgagtaagacatgtaacgtaaccaagtctgaccatttgtcgtcaccttaccattgtaatagaccgtatcgccagcattataagacccaaccgttgtcgcactagttgcaggtgaactcttgattgctgtcgttttcgtgaaacgatacgacccactggttgcaaccacgtccggtttagccacagcaccaacctcatcaccactcatagccacgtaatgctgagcgcctgaataggataaataccgtaaccaagttgtcccacccgtggtaatcttgccattatagtaaaccgtctcaccagcattataagtgccgaccacttgagccgttttgcttgcagctgatcgaatgttggtctttgcggtaaacttatacgacccactagctggcgtaactgtcgcctggttattattatcattagttgttgtttgactaatcatcacataccgtgatacgccagaataggactgatagcgtaaccaagttgcattaccgaccgttaacttaccattgtaattgactgtttcaccagcgttgtaagtacccactacggcactcgtggcgtccggcgcattgtgaattgtcgttgtcttagtaaacttatgtgtaccactggttggggtgacgtcttgatcaggctgaacttggttattatcatttccgccacttgcctgaccactgagcgcttcttgatcccactcgtgtagcttgttatattcaatgatgctgatcagcgaactcgcgtacgttggcgcggttgcgtagccgtcttgttgcaagagactggcaacgcgccgataatcggtaaccccaattaaattgctgtaacgcggattgacaaccaaaaaggcgccatgatcttcaacactagctgaccaattcgggtacttccgaaaagcgtcttgaatcgtaatgtattgtgagccattccattcctgggttgggaagtagattgattgcccttgataacttcccttgataccgaataagttgtttccctgagttgcaagttgtgattgtccccaaccactttccagaattgcctgtgcggccgtgactgatggcaagacttgatacttgttccaaccagagattgcccccgctttaatctgactcaggaagatttcctgactagtcattgcccgcatggaccgtgccatcatcgctgatgactggaccgcatcagccgccacagccgtctcaatctttggagagattttcgcggctaccgcctgctcagtcgcttgcttaggtgcggctgacgatgcggctgatttggctacttcactcgtcacagtcgcgctggattggtccgtagtgacatgactatcctgacttgcggccgcgctggctttagccgtctcattagtcgtactgtgactggcttgactcgtggctgcactagctttggccgttttatcaagttgatcaacagcactagttgtggagtccgccgtagcactagcagccgcgttatccttggcagcttcactggcggaggactggctttgcggtcctgtactgtcagctttagcggcttgactggctgcccgcactgtgacacgacttgtcgcactggtagtagccgtcgtcgtgctggtcgattcagcttgatcgtcagtcttggcaccgtcactggcaactgattggtcagtcgcaccggccgctgtcgtttccgtctgactgccagcacttaaggtcacttgttggcttgcagctgaagcagcgctgtttcccttagtcgcagctgccggtttttgatttgcacttgccgtatcagctttaccactcaacatcggcagcaaagcggtacttagcaataatgaagttactactttttttgtcattccaattttcaattttaaaatccccaaactttccgtgagttagctgttagcacaaccgatttaattcccctgtagcacctgctattacagaataatattagcatgtcgaagagggacattcaaacgagatcgcttcgaattattttattaatatcaattgattgacaccgttatcattttaactgattgatcagttaacaatttgttatcgttgaccgaattgacaatcgctgcaagacgttatgaccaggggcttttccaaaatcaactcgcttctcaattactgtatttaaattaaatgtgactgattgatcgattaacgaccttgaagaatattatttttcaaggactagtaccgactgaaaaaaattagtcatttttcagtccattaaaataattatccttacaaactcaagttatcaaataaatcaatcgattttaaatgcttacattgctgaaaattaatgctaaaatatagttattaactagccatatcaaacgggggtaaccattatgttacaacaatatcaaaatatcctggtaccagttgatggctccaaggctaccgacgaagttcttcggcggggcatcgaagtcgctaagcgtaacaagacccatctcgacattttaaacgtgttggaagtcaaccaatttagtgacacgtacggcggtgcggtcagtggtgatgtcatctacaagttgtcggaagacgttcaaaagcgcttggaagaactcaagcaacaaacaattgacgctggggtgaccgacgttgatgtccatgttcgttttggtaatcccaaaacggttatcgcgcgtgaatttcccgctgaccaccataatgaattaattatgattggttcaaccggcttatctgccgttgaacgtttgatggtcggttccgtaaccacctacgtcagtcgcaacgcaatttgtgacgttttgatcgttaagccggccgctaaaaaagaagactaacaaaaaagtctggatacgttccagacttttttagtggtttccgtgcgttgcccgtcttcttccccgttataaaggagctttattcatgacctggacttatcaactcactatcccgtctagtttgaatcaacagtcgattcgggcttgccttcggacttggctgattccaaagcggattcagggccagttacgccaaacgcggcggattcagctgaacggtgcaccaacgtcaattgcacaactcgtcaatactggtgatcgcctgacgctgacgtttatccccagtgactttcggactccgacctcgaactatattgcggctgccacggccccagccacgattttatatcaaaacagcgatctgttagtcgttgataaacccgctggcgtgaaatcgcatcctaatcaaccaggtgaaaccggatcaattttaaatgacctagcagccacactccaaccaactcagcaggtgccatacatggttcaccggctcgaccagatgacttctggtgcgatgctagtcgcattgaacccggtcgtcgtcccgattctagaccgcttaatcagtgacaagcaaattcgccggacttattatgcctgggtacgtggtcactttgccacgccaactgggcatttcaccgcgccaatcggtcacgatgctaccgacaaacgcaaacgctgggtcaacacggccgatgcccagccagcactcaccgactacgaagtatgtgcaacaaccgcccatcagagtttagttaaactgaccctgcatactggccgtacccatcagctacgggtccacttggccgccagtgaccacccgattatcggtgatccactttacgactcgcaagcggagtcggcgcctcggctgatgttacatgcccaattgttggatctacaacttccatttagcaccacacgggtgacggtaccggccccattgccaagtttatttgagaagccgcatttaatcgagaactactgattgcttgaatctgtttcaagcatagcgaaacctctaaaattagtgctaagacgcttaatggattaaggaggattcccatgttaaccgagataggcaaaatcattcggcaacgccgacagcaacacggcatcaccatcgagcaattggccgaacaatcgaatgtttcaatctcgctaatttctcgactcgaacgtggtaaggtcgataacattaaactacaaagtttgaccgcaatcgctgaaactctgaatttaaaaatagcggacttctttcgcgacgagcttctccaatcacctaatgttgttgcattactcgactacctgagtgatctgccagcccatcaacgtgaagaacttgccggtacgttactcaaactactccgactatccaaatcgtgagcatttgcgcaacgcactccggacagttagttcaccattgaaccccgtgattcatctacactaaaaaatgattcaccttcctctgacaagaaggcgaatcatttttaatttatcaagcttgttaacggtcggctaagcgcccttaaagccagcatacagttcttaatggtgcgttgtcactaataacccactcatcactgccaatatgatacccaccgccatggctttgaatggttcacgaacgatgggggtggcggtcaacgcctcgaccatcgccccacctaaatacgttacaacgagccccaatacggcgccccaaaaggttgtgactagtaaactagccagccacgttgtcttcaatagcaagctcctccaatgcggtcaggcacggctgaccttttgattgagtgtatcaaagtcgtcacgcgtttgcaaattgattaatagaattcataacttttatataatagttctatccaaagaaaatccccaccatcaatgacaaaaaagctcagcaccgaccattcaggtcctaagtactgagcgattatcatgaccgctatgacaggctaatgtcccccactactcaaatccgcaggccaatttgattcgacgaccgtttgcggaacatattggcgattcaatagtgccagccactgccggacaatcttgctcaaggtaaagtcatgactgcgttgccgagcgcgcgcggcatattcagcgcgacagtcaaaatcagttaacagtggcattaagccagtaatcagagcattaacatcgcgggccggagtcaacacaccgtactggccaccctgcaagtactcggctgagccagtattccacattgagacgatcggtaaccccatcgtcatcgcttcccccataactaatggcatcccttcccaacgcgaagtcatcatgaagacactcgcctgttgataatgcgcccgtaactcagtatctttcagcgcaccccgataaataatgcggtcacgaacatcgagttcagccatcaaccgattgaacgtcgctaattggtcttcgggaccagtccccgcgactgcaatttgccaatcatcgggcaaggctcgcgcaactgtcaacaaataatcgagccccttatgttgcaggtcaatacgaccagtgtaggcaatgatatgttgcgccaagtcggcctgctgaccatgagcttgcatggtcggtggattatagaacttgaccgtatggacgttaaaacgtgagtagccttcccaatcataatcggtcaatgtcacgaccgtatcagccgctaagagccctgcgaccagttcatcttgcatttggacgtaatactgattgaggtagatatcaacattattgtgcatccacgcaatgacattgacccgtggaaaacgctgtttgattgccggagcaaaactcgtcagtaaacctcccgggagaataacggcatcgtaagctcccgacccaatcgtcgtgagtaaatcatctatttgaggcgcataaacggtcaacggatcagcgccaaagtaattaagtaccgtcgcacttgcaggccggcgcgccgtgataagcggtgcgctcagttcatagaaagaccggggttgggccaaggagtaaaaggcaacttcggcttgcgaggtcaacgcattgccgaggaccgtcgccgctcgtttgacaccatccatcactaaattctcgactgttatcaaaattttcattagcatcgttgactggcgattaaacaaccagtcgctcctttccacataaactcggttcatggaaccggaatcgacgatgttaggctgagctgattgcgtcagacccgttcatccttaactaatcaccatcactagtatcagcttaggtagcgttattataacaggaataattaaaaaccaattaaaatatgctcacaattcacattatgctagtcattgcaagttgcttcttgattaaacgtcagttagctaggttctgattaagacatcataggctacattccagcaccaatcagcacttgtgacagtatccaatcgacacaattaatagcgcacaaaaatagcgttgctactggaggcacaggccagtagcaacgctattttcaaattaagattttaactgcttattttaaacccttccattgccaatcattaacttctggcaagtcagttccggcatcccggatataggcattgtgtttagcaagcatattatccatggattgaacgaaggccgcaccggtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatccgacaagccccgtggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcgcgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataagcggttagacatggtttcatcaggtccgaacaaccggaagttatcaggattcttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgtcgcatcgtcattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttgggttagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatttcaaaaacactccttaatttgcttttcacttgaacgctaactgtttaaatgttttcgtttacaagttctattttaacaactcatttcaaaaaatcaacctttttgttaattggaacggtccaattttataaattaaaacaaaaaaacaaggctcatcccttgggacaccttgcttttagattaatatattttttaataatttgtacacagaatgattgaagcagcccatcaattagctttaatatgcccagaattaacaccggcgccctgattagttagtggcaaccagttcagtgcttttaatagatagcggtcccagaaatcccactcgtgcgctccagaaccgaccaaatattcatgcgaaacttttttggtcgttagaaaatgatcaaattcatcattcgctgactttaagccgtcctgatcgccaatcgccataaaaatcgcgggtaaaacgacgtgagctgccagtaaattagttacgagcacttgcaggtttaattccgaatgaccagcagctgctagatctgggccaaaaacgccatgctgatatgcggccgtttccgcaaaccactgaggttttgccggtaacttttccattccgggtcgcacattcagtccggctgataaactcacaatggccccaaaagtatcgtgaaattttagtccgttatacagcgccccgtaaccacccattgataatccgccaataaaagtttggtcacgctggtatgatagtggaaacgtccggcgtgtaaaatcaatcaattcctgaccaataaatcgactatacgtctccccagaccaaggatgatcagtatagaaactattctcgcccgctggcatcacgacagccaggttccgttcgtcggcccagcgctggattcgtgtgccactaatccagtcgacttcactacctaagataccgtgcaataagtacagggtggcaaacggaccctgaatcgggcgcggcacgccctgctcatctgggaccaatttatccgttggtaaacacaccatcaggggaacggtccggtgtaaactagccgccataaaattaatacgaatcagtgccatgacacctcagactcctaactattcgttgacacaaacgttgtatacttcatatattgataatgtagtcgcatattagacacttcaaagggtgtcccatcatctaagaagaaaatcccactcatcaggcccaccggttcatttggctgcaaatgtaacaactcttgatcagtcgtattggacgcatcggccgcaatcgataagaatgatttggtcactgcggcgtgcaaggtcttttgcacgtaattaaagatcgagccactgaccacttgccggttcaactggggcacaagcttgattggaatatagccactttcaatcatgaaaggctggtcatccagtaatcgcagccgtttgatttcataaacaaactcgtcagcagttaaaaataagtcttgttgcaactcttgacttgcaggaatgacgcgaaagtctaataattgaatactgggcttagcaccctcagtatttaaactgtccgtaattcctaggttagttccttcatacttaaacgaagattgatttttaagatataatggattaatgaacgttcccgaaccccgcttcttgaaaatcaggcccttattggctagcacgttaagcgcgcgcttaatcgagctacgacttacctgatattgttcgctaagactacgttcatctggaagcttcttatcaacaaattcattcgccatgatccgtttattgagatcattgatgacttgttgataaactaggtcagccattgtaatccctcctttgaggttatttcatacctcaagtatagcagaattaatggcgtttgggtgaattgttccggtccatttataaaattggaccgtatttttaataaatgtgaggttaacaataatgtcaaaaaagaagaaaaaagatcaattaggtaaaacacttgttgaaaagattttggataaagcaaatatcagctatcaacaatatgaatttccaaccgaagcggaaggcgacgttcaacaattacaagtcgaccacctcggtgttgacgaacatcatatctacaagaccttagcgctgattggtaacaagactggtcccgtcgtcggtgtcttgccgttagatgagcacctcagctataaaaaattggctaagctatccggcaacaaaaaagttggcatgattccattaaaggacttggaacgaactaccggataccaacacggcgccaacacaccagttggtatttgggaaactaagaagtttcccatctacttagacgagaccgctaagcagcaaggtaagattctcgtatcttcgggtaaaatcgggcgttcaattgaaatcgacgctgatgatctacgcaagctcgtgcacggcacttttggtccaataacggagtagcctcgtggataacttgatcaagaataacggcatcgtcttgctggtcatcattggtttacccggactattcgcttggttactgacgattatcaaccgacaaaccaaagtgaatctggtcaaccactacggtattaacagtcaagtctactgtggttttctgggcatcatcatccacgagcttagccatctaatcctcgcactgatttttcgccacggcatccaatcggtccggctgctcaaacgccctcacctccatcctgaagatgagtcggcggatgatctggcactaggctatgttaaccatacttggaatcggcacagccggtatcaagtcattggtaacctgttcattggtgtcgcccccatcttcggatgcacagcggcactccttggactagactggctactcgctcctggcctatttcaagccatcttcaaattagctgatacacccgaacaaccgcaatgggctgcaagttttcacgcgttaaccagtacgccaacgagttggtggcaactattaatgttgctctttctaaccctcgtcattgtgattggtggcttcgatctaagtcccgctgactatcagaatagtgcgatcgggttgtatagcaccatcgtcatcattatcgtgctgactaccttactaacgttcatcggtatcaccggttggatccatacgttagttacttggggactaatggtcgccattatcttgggctactcactactcgtgtccctactagtcatgttggtaacccatcttctgaccaaccgtgcctgatttagattgccagccttaaaaccagaataagggctaaaaaggccatcacaagaattcacgatacattcttgtgatggcctttttcgttagccaatataaatggtaattgcatcatctgataacatgatctcagctcaaagaactagtgactcaactagacgtagggatgccattacgccttatcatccgccgtccactcagccttaaattggtcaacaaactcgtgcatcaccgctgtccggtgggctgccagtgctttggcagtatccgtattcatgagagctgctaacttgaacaacttttcatagaagtgattgatagccgtgccgggctggtgtcgatattgttcacgcgtcatatgttcacgtggcgcaattgccgggtcatagattttttcaccgacatgacctgaataatacaacgcccgggcgatcccgatagcgccaatcgcgtctaaccgatccgcatcctgaacgacttgcccttcaagacttaatttttgagggccgttgaaggatttgctgaatgacatgtgatcaataattgcaaaaatagccgtttgatcggcagccgtaacattttgcgcgttcaattgagcaatcaaatcttgatgcgccttcgctgggtcggccatcaatttatcgtcgatcacatcatgcagccaagctgccgctaaagtcagatttaaatttgccccttcggcttttgccagccggcgtgctagccggttgacccgctgcaaatgatcgcgaccatgcccactatgatcgtgagcaagcttttgcaaagcatacgtttgaattgccgttaattgtgtttcagttatcatacactcatcctatccctgggtctggtagtacgcccgtaacttcttgatcgttccccggctaaaggtcaagtgatcatgattgtccatactaatcacgcccttattaaaatcaaccgtaatcacatggtcaaggttgagggcataactttgaaactcattaaaaaaatgcatcgctgtcagttgttccttaatcgtatttaaattcttatgtacgacataggactgggtcgtcgtcacgattcgcgtggtccgcagcccatgttccttctcacagtagatgatatctttaagcttcagcgttaataataacgcaccacttcgaatcgttaaagtcggttcagcagattgctgtaacatacctaaccgtttttttacgacttgtaggactctttgtacttctggaacaaactttgccttatcgaacatatttgtttttgaaataaacccggttggtgttgtcatcgcactcaacgtatccgggatcatgtcatcacgcaccgtcacatagacaataaacccatcaggatcataatcacgaatcttagaggccaattgaatgccattgatttcgcgttgtaaaacgatatctaaaaaataaagatttggtccgccgccatcctttaccgccgctaacacatcggtcggctgccatactgagactaactcataattaaagtgcaatgcctccagctgtgccgtaatgatgtcgtttaaccagagacgctgttgttcttgatcgtcactgataaacaccttcatatcaatcactcttcccaatgtaaagcagattaacaaacaaaccactgttgatccactctatcccaatttaaattgcttacaatcattttatatgatactaaagccccgccattccagcaaccaaaaaaacacgtatggaccaaataactgacattacttggtccaccgcattcagcttatttttcaatttgttgtggcttggtctgtacttgattaagtcgcaataattcatccgtgcgcaatttattaacaatcagttgagccgctgcggttgttaaactgtgactgagatcctgatcagaaatcgtaattggatcatcgggatgatgaagttgattcgttaataccgtaataaaattgtcgtaagctcgcttgggatagccagtcgcagtcacttggtcaattccctgacgaattttatccagtggataactcggttttagtaagctaatgacaataatatccgccaattgcataatttgatatttcttcttgactggtgacaagatcactttatgtttgacgtaattattgatcattgcggcagtaactggatcagcacctaatggctgcaacgtttcattaattaataataggacctgatccatatataagtcaaagttcggtaactcgatccacttcggcagaatcacctttgccatgcgggcttgccaatctgcataagtctcattagctgccatgctgcgtcctcctctgataaataggttacattaattatacctagattaactagtcttgtaaactagatgacattgtaaatcacattaatttctgaatatggtatcatttatgggttaatgcaaatacaaatgaaaagtaggttatgtagtatgtatgaaatgaccaaaaagctccgtgtcggtgacgatgttaaagaaatgatcccacaagcagtgattgccggactttgggaccgtctcaaagcgatgcgcaaagagaaattattgattgatagcacgatggccatcatgttcagtgacgattacgaagacaataaaattttcttcatgacacttcaaaaatccggctcattcgccaatgaatatgaaatggcctatgatgggcccaaagacttcctcggccatgggacgattgttattatcaaagaccgtccccgtacgattcaaatgatcatctcggatgctaataaagctgaagacaccactgacgatgcgactgatgagcaaaagtaggctcgcactttaaatcacatcatgattgctaataagctgctcaggtggtgaccgatgttcactgactaccccgaatttgtacctggttatgctacagactttcagattcgtgctcacttaggttgtcacgactgattgctagctctatcaactagttgagacagcaccttgctaacaacacctctaagtgtgcaaaaaaatccgttgtcatcaatgtgtatgtaccgaataaaagcaccgtcaggattcgctgacgatgcttttatttattgtatttcgatcttaccttcgctatccgcaacggtttttggcaacgtcacggtcagcagtcctgcttgataatgcgcttgaatctcttcgcgcacgacattcgttagatgaaacttccgggtaaagtccgcgtccattcgttcgcgatggagtacgcgcccgtcatcgttgcgatcgtcttgcgaccggtgcgcccgaatagttagccattcgtcagcatacttcaccgtaatagcgtccttatcaaaaccgggtaattctgccgttacggtgtaatcatcgtcatgttcaaccacgtccgttttcatcccaacgtgtgcgtttaagacgttctctgcttcccggtgagcccgcttcaataatttggtgggctttagtagatcatccagatgatgaccgaataattgctggcgcatgtcaataacctccgtatcaaatcaattattagtaagcctgttggtgaatggcttcagcaagtaaatctaaggcatggtcacgcgtgccaacttgatccatatcaaagatgattgagtcaatgtcgccacccttgaaatcaaattgttcgaagtagatgtacgggtcttcgccttccacttttaggaaagcggcttcaatcttttgatcaaaaccggccgcccaatccgcatcgtccatctgattgaaatctgcacgggtcacgtaaccacggtcacgaattaaatccatcgcttttttgacatcactatcttgataaaccaatttcttcgaatcctcatgaatcttagttttcgtttctactggcatcattaaagatctccctttacttggtatacccttagtttagcaccattcattggaaacgttaaccatctttctcgcgatcgcattattggcgcttaaagggttgccagtaggcccgctgactacgatagaccaattaattaaccgtcgcgggggctgacaaaacgggtgataagccttataatattagctacttcgcgttatacttaaagtaactaatattatgaaatgaggaatgtttctttggacagtggccagataattttaaatttagtcattattgtcattacgttcttcgtcgcggctttctttgtggcctgtgagtttgcactcgttcagacccgccctagcgctctcgaagaagaacaaaaaaaacgtgataaaccgtcaaaacggatcgcaacttctttgcacatggtccgcaaccttaacgagtatctttcaaccacccaagtgggggtctcgttagctggtatcattttaggttggattggtgaacaaacaactgaacactttgtgcttgatttcttatccctcttcaacctatccgtctcaaccgcggtattacgaggtattagtatcgtcattggggttttcctactgacctacttagaagtggtcttaaccgaaatcgtgcctaaaaatatcgcaatcgacatgccactcaaagtaatggcggtcattacgacaccattacggtggttccacgtgatgttctacccctttgtatggttgttgaatgtctcatcagctggcgtcgtcaaaatgttaggcattccagttgcgaatgaagataacgatgtttattcacaagccgaaattcttaacctatcacgaaatgccgtaactggcggtgagcttgaacgtaacgattacctttacatggagcgggcatttgagttcaatgacaagatcgctaaggatatcatgatcgaccgtactcagctagttgtgattgatatcaacgataccgtcaagcaagccattcgcgtttatttacagaaacgctttagccgcttacccgtcgtagctaacaatgataaggacaagattctgggttacgtttataactatgacttaattcgccaaggtgaagttgacgatgatattcgggtcaataagttattgcgtaatatcattacaattcctgaaactacaccgattcaagccattctccaaaagatgatcgacaaacaaacgccgatcgtcgtcgtggttgatgaatatggtgggaccagtgggatcgtcactgataaggatatttacgaagaacttttcggaaccgtcaatgacgaaatcgacaatgtttctaacgaatacatcgaaaagcaggccgatggcacttaccgcatcagtggtaagatgaccatctacgactttgaacgctacttcaagaccgacttacaagaatttgaagattccgatgttgtcactttgaccggttatattttggataattttcctaaaatccaagccggtgatacgattcaaatcggtaacttcaatttcaaagcgcttgattttgaaaatgcttatatcaattggtttgaggttagcgcccagacggatagcacacctgacgatcacaatgacgatcaaacacaagactaaatatttacacgcactacttaaaatggcacttaaggaagttgatttcttaggggccatttttttgtatccggcgaacttcaactggtcaactttggtacttttatatgataagtcgtgtgaattgccactaacctgttgtacataaattggatgcggttgatttaagggaaagcctactaaaaattaagtttatcttaagccggccgttatcacgacaaactgcgacgattcggagccgtagtcgtttgcaattaagtagtgcccagcgtaaactaaaactaatgtaaaacagaaatgaggaactgctgtgagtgaatcaacaatcaatatcatttatatctccattgaaggcaatacccgctcatttgtcaccggtatgcaggattacgccaagacccagcatgcagctgatgatagcaacccgttaattaccttaaaagaaatcaccgaacagtcagactttgccattgagactgaaccctacttcgcctttgtcccaacctaccttgacggtggtaacggcattgacaatggggttaaggaattgatgaccaacgtgttaggtgaatatcttaactacgatcaaaactcacggttctgtctcggagttgttggttctggtaaccgtaactttaacgatcagtactgtctaaccgctcggcgttatgctgaacaacttgacacggacatgattgcggattatgagcttcgcgggactgccgttgatactgaacgcgtctataacgtgatgaaagaccgtttggccgcctatttagacaatcaaaccttttaatcgaattaaccaaacaatcaaggtccaagttagttttcgctaacttggaccttgattgcgttcacagcacgaagttgaccaatcgcctcagtaacgacgatttcacgctattccgttgccttatccttatcaaatattgtggggccgatgactagtgattccgctaataaggtttcattgtacaatttaaaaacgtacttctgatacttgacctctcgttgtgaaatcatatccaaatattgccgttcttgttcgagtgcattcataaatgctcgcatctctaattctttttctgcaccagtaaattccggtcgccgaacaacgtcaacccaggcccgtgcaaaatcacgagtcctagtccgttgtttctgggtcatcaaatcaaaaatgacggattctttcacattcggcggcaaatacattttctgaactgtatcaatcgcgtggtgaaccatcgccacccgaatctgatcaatctcactagttgcctcatcatcagtcaacgccggctttagcaaccagcgaaaaataatcgtcggcacgaccatactcagaataatcaacgtactggcagccattagaaccaagttaaagtcaccacgtccgaccgcagtatcggttaacgtataggctaaggccagcgttaccgcaccgtgcacgccacctagcgcaaaaatccatgcgggccgatttttgaaactcaaccgcaaccgaccgtagctgtaacgcaccagcacattgctaatatacagaacaagcccaatcaacaaaaagttcaaggacccatgcccgaattgttcgttaacaagaattttgataaacatgaatccaagaaccacaaacaccatgctattaaagatttcagtaatcatgctcaccaagtcaaaagcaaaatgaacttgttgtgcattaattaaccggcttcgttgggcttccgcattatgcactaatcccgcaaccacaaccgtaatgattccagaaacgtgaatcgcctcagcagcataatacaaaataaagggcgtaatcacgtacatcaacagcgacgcattcaacgaattatacgaagagcgtaacaatacttgccgaaacagaaccatgatccaggcactgacaaaaccaaagagtaccccacccacagctgaaataataaaatcaataatcgtttgcccatagttaatatagccattagcataccagagaaccgccatgttcaataagatgatgccagaagcatcattaaacaacgactccatttttaaaaaagttccctcagttgatggcatctccaaaccgttcgtcaccgattccattgccgtggcgtcggtcggcgtactgatagccgctagaataaaagctaacggcaagccgactaatcccagccctgccaagctaaatcccgcgacaattaaggcaagaatgactagtccaactgtcgtttggataatgtgctttaattccttaccaacagcattcagtcgagtggcttgtccttcaaaaaacaggagtggcgcaacaatcaggccaataaagatttcagaattgaagttttcaatatgattgctcaaaactggaataaaaaacaagccaataccgacgatcagactcaagtagttcacagatatttgcggcattacccgggaaataaaaatactaacaaccgcagccaacaccagaataaaactggaaaccatcaaattcacgtactcacctcattttattaattaattcatttattctatccgataatgctcaaattgtatcgtcaatcgtctccatcatcactttcaaagaatcaaaaaagctttcaaggcatttgaccttaaaagctttgttaatatcacggggcccacctgctccttaaccatttaataagtgttctcgccgggcgcgccacaagactaacgccaaactacctaacattaagatagtcaccgtaataaacaataacgagtaggagaactgagccaccatcatgccaccgaacaatggtcccacagctcgtcccaatgacaaagccatgttgtatcggccttgatattttccgcgctgatcatcagccgccatatcatcgacccaggcgggtgcaatcggtaagccaatgacctcaccgatcgttaaaaccaccatgataataataaaatcaacgtattgccgggcaaatactaatcccaagaatgataaggcaaatagcgtaatgcccaagccaatctgagtgccaatcttaaatcgttcgttgaataacgccacgatcggctgactcacaataattaatagcccgttaatcgtccaaacttcactataccggcggaacggaatccccaagttggtcatgtgcacggaaagaatactttcccataaggcataactcagataaatggtgaaaatcatcaaacaaatcatccagattaattgacggtgatttttaggcgtcacatcccgcttctgtggcgcagctttctctgtccgaacagtcggtgtgacgttaaaggtacttagcgtaatcgtcataagaccaaggtagcaaactgttgccaccatgaacaccacattgatacctagttccaacaagtaaccgaccaataatgtcccaataacgaccccaacgttgagtgctaaataaagcatgttaaaaacataccggttggatctagtcgttaccgttgcggcataggcattgacgactgtcatgctgataccatcaccaaagccgacaatgatcaagccaatcgcgtaaggccacaaactatgccagaaaatcaacgttgttaaaattgcggtcgaaataccaccaccaagtagcgctgtataatatggtcgccagtgatcaaacaagcgcccgccaataaagttaccagcaatcatagccaacgacatcaaaaaaagaataattcccgaaaacgtcaagctttgtttgagataattatgcatgtagaccgttgttaatggccacataaaagcggcacccgcattattcagcaaattggctagaaacagccaccgtaaccgaacttctttttgcatctcctcaccacatttctgatttaagtttattcattgagaaaacaataccctaaatagtatacgccgcctgaccgtttttacctaccaatcaggtcgcaaaaggtgctgagtagtctacgaaatcatttttacttaagccgcgcttagcatcaagtcttacactgcatgttgtttacaatcgcaacgctgtagtcgcagcctaggcccgtgctttgaccatttggtgcattctaaatgcggcccccactccgcggatccgtttcatccgttttagtattgttccgagaagcactgaccacgtgtatactaaagtcaaaaaggagcaattgacatgagacttttcaccattccagccgaacaaacggcatttagtaccaaagaggttgtcgccatcaccggtatgaccaaggacgccctccgttattatgaacaacaacagttgattgggcccgtaccacgcaaccacaacaactaccgacagtattcacgtcaaaatttagagcgtctacaattcgttgccacttttcggcaattaggccttgatctaaaactactcagcggtgacggccacattccaaaccgggcccagcgaatccaagaactgagctcatatcgtgctactgtgaaaaagcaaatcgctcaattacaggcaactgatcagtttttagcacataagattgcttactttgaagcttctccaaatcattaaccaacttttttactttttacttgctatcgtgtggacaccatagtttatactaacggcacacttaatcaaagaaggttacgatattatgaaaacaattgctattaaccaatacggttccgcagatgaatttacgatggtcgacatgcccacgaccgaaccacaagctgatgaagttcaagttgcgattcacgcctttagtctcaatcccatggatattgctggccggatgggagccctatcctcaccttttactgacttatgggcctttccattggtcttaggttgggatttcgctggtgtcattaccaaaatgggcaaggccgtcactggttttaacatcggtgacgctgtttttggttccgccgcgcctgcccacgcagctaataacggcacttatggtgaatttattactgttaatactaaagaattagcccatctcccagcaggcttatcatttgatcaagctgctgctttgccaatcgctggactaaccgcttattacggcatgaagcacaatcttaagctgcaatccggacagaagattctggtgcagggtggagctggtggtgttggcctctttgcaattcaaattgctaaagcctttggcgcttacgtcgcgaccaccgctagtgctaatcaccgtgacttgttaactcgcctaggggccgatgaagtcattgattaccatgaaaccgatcctgccgccgtcttgcacgactatgatgccgtttttgacaccgttggtgatattgatactggtctcaaggtcctaaaagctgacggtcagcttgcaaccattgccggtcaaccgacggacgagcagcaacatgatcaacagaaaaaagttgcctttcagttcacccaaggctcatcacaagacctagccgacttagcccaattagttgtcagcggtcaagtgaagctaaccgttgcgacattaccgttctccgtagccaatgtcattaagggtcatcgatccatcgaaagtcgccatacgacgggtaaaatcgtcattcacgtgacggattaaccaatcctactactcaataaatatcttccggcaccattcttagtagctagtcccactgtaaaaatgaacgttcagagttcgaaggacttctgaacgttcatttttattttagcggcccaattaaccatggcacacttggtaacaaaccaaccaatttaatttaatgaatcactttaaacttcccagcacacttaacaaccagttataattcacgatgccatgatgaatttggactaagttcaaactgtctcaaccaggttgtactaatattaattcgacaatccataaaaattaatattgaaatgtccggtttttgaacctgattgtcgactaccacccctgatgattgttataatataattaaacactgccaaccggtgtaatctttcaacaattgaggtgacaacatggcgaataacaactttggcttggcgttaggcttcctagtgattctgttgctctggatctatcaacgcgtgcgaatgcctaagatgcgctcactcgctggctacatgtcgcgacgcgcgattgaaaatgaggaaacatggcggttcgcacaacgcttctattcaatgtttggcatcgaaatcttttccattttgttaatcggcgcgattattggtggtctgttcaagattccgctattgcaaagctttaattttcaagccatcgccttagcggttggtttgatcatgcaaaacgttgcaactgagcgtgaactgaaacaccagttcccaaaatctccgcaacattagtactttataattgaccatcaccacgtatggtttaatattaatacggtagtttaatctgaattaatgcttatgaacaagtacttggtttaaaatattcttagtaaagaagtgaaattgatgagtaacgaaaaaattgccttattcaccatctttggcggtactggtgacctcgcacagcgtaaactgtacccgtcactatttaagctctatcaaaagggctatctcaaggaccactttgccgttattgggacggctcggcgtccttggactgatgatcactatcatgaagttattagtgactccctagctgatctgaatgctgatcaggaaacggtgacgcaatttgcgagccatttttattatcaatcgcatgacgttactgatgctgaacattaccgaactttgaaaaaattatcagaaaagctggacgcccaatatggtttacaaggcaaccggatcttctacttagcaatggcaccaaacttcttcggtacgattgcccaacacttacgttccgaaaatattctgacagataacggttttaaccgcgtcattatcgaaaagccttttggtcatgattatgaaagtgccaaggaacttaacgaccaattaacggctacttttaacgaaaatcagatttatcgaattgaccactaccttggtaaagaaatgattcaaaatatcacggccattcgttttggcaataatatttgggaatcattatggaacaaccgttacatcgacaatgtccaaattacgttaagtgaaaaactgggtgtcgaagaacgggccgtttactatgataacagcggtgccttgcgggatatggtccaaaatcacattttgcaaattttgagtctgttaacaatggatcaaccagttgaattcactgaaaatgatatcgacgtggaaaaggtcaaggctttacggagcttacgaccacttaaaccagaagaagtcgcaaccaactttgtccgtggtcaatacggtgccggcgatgatgctaaagcttaccgtgacgaagataagatttcatcagattctaacaccgatactttcgtcgctggtaaagtcatgatcgataattatcggtggtccggagtgccgttttacatccggactgggaaacgcttagccgataagttcacgcgaatcgacgtggtgttcaaacggccagtcgtcaatatcttcaatcatgaagacgtccgagctaatgacgacgcagcaaccagtctcgatccaaacatcttgacaatcaacgttgaaccgactgaaggcttcgagctccgcatgaatgctaaagcaatcggccaaggcttcgcaaccaccccggtcaagttgaattattctcacgatgctgaagccacggctggtagcccagaagcttacgaacgtttgcttcacgatgccttaaatggcgacgcaaccaactttacccactggcaagaggttgccgattcgtggaaattcgttgacgtcattcaaaaatactgggatgaacatcaacccgaatttccaaactaccgccctggtacaatgggaccagatgcggccgatgaattattacgtcaagatggtcaccgctgggtctaccgcaactagccgtcctagcgtattcacttaaatggcttaattaaaagaaccagttaccaacacttgcctaacaacgtgttgataactggtcctttttatatcgctttaacaattggatgggttgctgcccatcggcaatacacgtttattttgctcttcgggattgcgcctgcggattagcttaactagcgtcgcaataatccctaacaccacccattccgcttataaacgcctaccctaccagttgttcacaaacttgaatcaaccgtttgacaccggtcgtcaactctgacagtgtcagcccggcaaaccctaacaagtaatagtccgccgtgggcatgtcgcgccaattggagttaagcggataaatccgaacctgttgccgttctagggcttctaataatttagcctgtgcaatgcctggaatctgaacaactaagtgtacccccgcgccggttgcaattggtcggatctgcttagtttgcgctaactggtgacaaagtacccgatacttttgtcgattagcagctcggtttcgactaaggtgccgataatacgccccatcttcaaaataattagccattgcttgttgtaacaggccggccaccatttcagcccgatattgataccgttgatgataagttgccaccagttgtggtggtaagaccaaatatcccatccgtaatgtcggatcaattccccgcgaaaatgtccccaaataagccacctgattagccgttgctagcgactgtagcgcgggtaatgggtgcgcactgtatcggtattcactatcataatcatcctcaatgatgagatgctgagtccccgcccattgtaacaacgctaatcgtttctcgatgggcaagacgactcctaatggaaattgatggccaggggtcgtataaatgatctgaggattacgcgcacgaacttgtgtcaaatcgagcccatcttccgtcactctgatggggaccgccgtctgtccataactagccgccaattcggataaaccgcggtagcctggattctcaattccgaccgttccgcgtggcaagatactaagtagaatactgagacctgccttagccccactcgtgatgacaatctggtccgctgtgcaccgcacaccacgagtcgttttcaaaaatcgaaccaagttttcacgtaaagccggtaagccctgcgcatccggataaacggccgttggttgctgctcagtctgacgcaacgctagtcggacagcccgtttccaagcgttccaacttggcgataacaactgagtcacaccataccgaaaatcataagtgaacgccctgggtttagtgggctgtggcacagtctccagcgcctgtttagctgctggccagtgtgtccgatcgcgataaaagtagccactcccgggaacggtataaacatagccctctgctagcaactgatcgtaagcttgttcgacagtggtcttggaaactcccaaattttgtgccattttacgaattgaccataactggtggttggcttgagtagcatcatagtcatcacgcatctgctggtataactgaatatataacggtgtcgttgactgacgatttaatggcatcacacaactgtcctttcatttttatcaaaattgtctatttctaaccggacgattgttgtttattataaacggtaatcacgttgagaggaaggtcctaatgatgaatacaaatattcggatccaacaaattcaagtctctggcatccgacgcttcgatgaagcaatcagtcaaattcccgatattatcagattaacggtcggcgaacctgacttacccaccccaagtcacgtaaaaaaagcggcaattcaagctattcataatgattggacacactactcgccactaatgggatttgccgctttgcaagatgctgcgagtcactactttcaacagaaataccaactcacctatgcacctgagcaaatcattgcaacagtcggcgctagtgaagccgttgcaacgaccctgctcactttacttaatcctggcgataccgtcttattgccaacaccggcttacacgagctatcaacccgtcgttgacatcgcaaacgcaaaattagctcccattgacacaaccgcaacgggttataaattaacacccagtgcgttacaagctgcgctagatgatcaccgtcgcgaccacgtcaaggccttaattttaaactacccgaccaaccccaccggcgtcacgtacactgatgatgaattacgggctttgcaagccgtcattgctaccgctggaatctacgttattagcgatgagatttacagtgaactaacctatgaacagccccatactgcttttgccacactatatccaagcaaaacgatcacaatcaatggcctctccaaatcgcatgccatgactggttggcgactgggattcatcatggccccaagtaacttgattaccgagatgaagaagacccaccagtacctcgttacttcaacgagttcaatcacccaagcggctggtatcgaagcacttacccatggtctggatgatggctcagaaatgcgtgacgtctatcaaacacgccgcgattacgtcgtcaaacgtctgagtgaaattggattcaattatatttatccgacgggcgcattctatatctttgtccagctaccacaggatttccaaggcaccagctgggactttgcgacccgactcgcacacgaggcccaagttgctgtcgttcctggctcagcatttggtacgagtggcaagggttggttccggataagttatgcagccagtcaatcggcactacgcgaagggctaaatcgtttagccttatggcgcgcccaaactaccacacaggaggattagccacatgaatttagcatccgcacacctgattaccgccatggtcaccccatttgatgaccaacaacacattgatttccaccgcttagagcaactgatcgaacacttacttgcaactggcacggacggcttattagtcgggggcacgactggcgaaggccccacgttgagcatcgctgagaaacgagatttatacacgcagacagctaggatcgttgctgggcgagttccaatcatcgctaatacggggaccaatgacactgccgccacaattcatttcacccacattgtcagtcaaatcgagggcatcgacgccgccctcgtcgttgtcccgccttataacaaacccaaccaaaccgggatgatggcgcattttacagccattgccgaaaaatcagacttgcccattataatttataatattcccggtcgcgtaggcgttaagatgacggtcacgacgattctcacgttggcccacaaccccaacattattgggatcaaacaatgtggttccgatgaagaactggccgcaattgttgaaaaggcgcctaaagattttctcgtttacacgggcgaagatgctcagagcttgaccaccctcgtcttgggtggtcagggaacgatttcagtggcgagtcatttatttggaaatgaaatggcgacgatgcgccgcgccttgaaccacggcgatatcacccaagcagggcaaattcaacgacgtttaatgccgaagatggcagcactattcacacaaccctcaccggcacccgtcaaagcggcgctgaacgcccaacactggttagtcggaagcacgcgcctaccaattttaccgttaaccaccaatgaacaaagtcaactactcaacagcttaaaataatgcagaacggttggtagtacctggcaaaagcgcgtatactgaacctaaaataattaggaaagtggtgaccatgatgtgcggttgggcttttactggcggtatgccctttatgtggatgggtggcggcttgggcattatcagcttactgattctgttagccgttggtgcttactttttagggacacgttcacgccatcacgattaaagttctcattgggataatcaaaaaagactttcaaggcacagcttgaaagtcttttttgtttcatcatcagggatcagacaaccgggtcaacccctccccatttcaggtgacctgcagttttgcctgatagtatcagtccaaacgctgatttagacccaatgacttaatttcaagatcgtaacgtaagtaagtttaccagccttaacattgctattgagtttgtccccactaacttcattttcactcacaatccataagccgatttgaacaaactggccgccagtcccaatgccccgattccaatcacaattttaagtaatctggcaggtaagtggcgtacaattcgtggtcctaggctaccaccaatcagaaaaccaatgcctaagggtagtacatagcgccactgaattggcgtttgcaagccataaacgacggctgaaacaatattggctaatcccaacgccagatttttctgagcattatagacgacgaatggtgcggcactcgtgaaagacaggatcgacaacatcaagacaccacccgcagcaccaaaataccccgtataagccccgactaaaaagatgcccaaccaagctaaagccgtcatccatttaggtgtcacaacaatttcaccgggctgtttaatatgaatatgacgaggaatcagcactaaaattcccgcaatcaaaataaaaaatgggacgaccttcgcaaaggtcgctgccgggataataaataacagaattgccccaacaatactcccaactaaagtcagtgggatgagcgtcttcaattcctgaccatgcccccgtagttcccggcgtgaggctggcacggctccaaagctagtaaagactaagcccacggtgttagtgacattagccgtaacgggcggcagtcccagcgccagtaggaccgggtacgaaaccagcgacgctaaccccgctgcagtgctaacgatacccgcaacaatcccaacaacgactaaaataacgattaactctccgaacgtaaacatgtgcaacgttcccttctctcttaatagccctacaatagccacaacgattaccatagtcaaataaccatgttataataacaaatcataatactaacaattaagcattaattaaataaggactttaagatgaatattaaagatttgcaatattatgtttcgttaactcagctgaaaaatttttcattagttgcagcccaatttcacgttagtcaaccgaccatttcggctgctattcggcgcttggagaccgaactgaaaacacaattactaattcgggctaatccccacttacccgtggcactcaccacgaccgggattcaagtccaacgacacgccaatcagatcctattagagcaccaactgatgtgccaagaagttgcccacaccacaaccgatcaacttgtcatcgggatgccgccaatcattgaaatcaactactttccccggattgcaagccaattaccacaagctttattcagccagattcaacctatcagtcaaggttcactcgcggcgctcaaaggattaaaaaacggacaattagacttagccgtacttgcttacctcaatgaattcacggatacgaccattcaactcacgacgtttgacacccagtcatttagtattgttgtaccaactgacgatccgctagcaaccaactcacaacttcagttcagatcgttgcgtcatcagcattttgtggcgctcaaagataactttgtccaccgccaggcgtttcgtcaactcagtcatcaaaatcatgttcggccaacgattgtctttgaatccaacgaaatcggcagtatcttaaacatggttcgtcagcatgtgggcattgccttattgagtaacgccgtccaattaccggcgggattacagcggctccccctaactgacgcgcaagcgcccacgttcaatgtcggcgttgcgtaccgccactcaatgacgtttagtccaacccaagccgacctgatccaacgactgaccgctgcttttcaatccgtcgattggcacgcatactaaccagcacctaaaaatccaccgtgtaagtttatcaatatgataagctcacacggtggattttataacgactgtacgtcaagttaggtcgccaaatgcaggtcattaaacagacaagttttagtaacctatcatggtcgctaacccgtctcaacctcagattaagcttgttgaacagccttcgagattggggtatcgccattgatcaacgcaatggttttaccgaccgttgcaggggtgtgtagcgtttgaactgtaaaagttgcgacatcatcacgcgtaatctcaccgccaacgtcagggttaacggttactttgccagtaccggcatcattgatcagcgtacctggttgtaaaatggtgtaatccaattgggttctgttttttaaccattcgtcagcataatactttgccacgtagtacggttgtaatgctcgtggccaacgactccgatccggtgtaaattcagcactaataattacgtagcgtttaacgccggcaattttggctgcgaccattgatttgacagccccatccaagtcaatcattaaagtcatatcataacccgtttgaccacctgatccggctgcaaaaacaatggcatccataccattaaaagccaacgctaaatcttcaggctgagccatcaaattgaattgtactggctgcgcaccagcatcctcgaaagcctcagcctgttctggttggcgaatacccgcgtacacttggtcaccttgggcaactaacttggaaacgattttcttaccaatctgcccatgggcaccaatcacaaagattttcatctgggtcactcctgtcctttagttaagtttcattataaagcttaccaggacaaaaaagtatcattctgttcctgatttgtccagtttacaaaattggcttataatatgagcatctaaacgagagtagtgataattcatgtcaaaatatattcgtcaagctactagtgctgacttaccagccatgatggctattatcgaacagggcaaacacgccttggctgccgatcagattccccaatggcaagatggttacccgttagctgctgatattcaggctgacattgatgctagaattgcctgggtactcattgtcgatgatcagattgctgggacggctgcactgctaacaacacctgaccccaattacgctattatttatgatggcagctgggcgcctactgagaaccaccgctatgcctcgattcaccgtattgctattgccaatggttaccacggacaacatctgactgacttttactttagcaatctcattaccatgagttaccaactcggctttcgtcaactccgaattgatacgcacttgttaaacaagcgaatgcaacacattattaccaaagctggcttcgaataccgtggtatcgtctacatgaatcatgacaacaacgatcaacggaatgcttatcagttactactatcctaatatttgtcagccacgcggcatttggctttaaacatcacgaacgctttaattaagaccaaactcaacaaaaagcacgccagattattctgacgtgctttttccaactttgtaagcaccacctgacagccaaacttaattaactggcacaaacacctgttgtggcagtgagtacaaatactgtttagtcacctttcctggatacatcgacgctagcgctgctgcatatagtttaacttgaccagcgtagcgcgtcttcaattcttcaggccgcttgacgtggtccgtcttataatcaaacaaggttaacccatcagccgtttctaaatagccgtcaataattccatgaatcaggacttttcccgtctcatgttcatcaacatcgaaaatctgacgtgctggaatcagtaacgagaatggcacttcgcggtgcaccttcgccggattatccaaaatttgactgcccagcgcactctggtaaaaagccacgatggtgtcaactgcaatcaatttcgcgacattggtcgttaagacccggttagccactaacccatcaatcgtactttgaaccgtcgtttcattgaccggtttggtcaaatcaagttgttctaaaactaagtgggtcgcactcccaacttccgcactggttggcgcctgcatagtttgtaaaaattgtggtaactccagtgaccctgtcacaaaccgggatgtcggtcgtgaacgccgctgactaacagtcgggttcgcattcattagcggagtatccggatcttcaaagattcgtttcacttctgataccgattgatatgccgtcgtcgtcgtggaagcctggtgtggataatgaaaattcagtaacgtggtcagataatcacgcgttacttgatcaacatcgatggtgacttgctgttcaactagttcaagcgcatcaggttgagtacccgataccgcttcactttgctccgccaggacggtggtggcatctcccaattcaacggctagcttggtcggatcatccgtcaattcgtaattgggccattcatctccccaatatgccttcatggccggatgccgtatcacggccataccgacccaatctaattgattagtcgccgcaatccgtgcttgggcacttaagacgcgcccgtcgctagcaaaggcctgccgccatttttcggtcgcggtatcaatatccttgattgttccaaccaaatagagctgttgctgagctcgcgtcatcgcgacatatagtttccgcatctcttcagcgcgcatcttcttgctgactacctgcttagtcacaacttgtggcaaggtcgggtacttcacacgcgtttctgggtccaaataagtaatcccaatccccgcttctcggtccaatagcgcgcttgagcgcgtatcagtctgattgaactgcttatccatatccatcacaaaaatcacggggtattcaagccccttgctaccatgaatcgtcattacgttgaccgcttccgcatcagtctcggccacggcagctgccaagtcctgatccttttcctgcatccggcgaataaaacgaacgaactgaaataagcccttaaaactgccctgttcatacgtataagcacgttcatataaagcgtggagattagcctgacgctgtttaccagccggcatgccgccaacgtagtctaaaaagccagttcgttcatagatttgccaaatcagggttacgatttgattacgtcgtgccagatctcgaaattcagtcaattgtgtcaagaaggtctcgatcttagcataaacttgatcaccatattcagtcgccggaccagtcggataatgatgataaaagtcctggacggcttgaaaataatcactcgttttattctggatacgcaaataaactaattgattttcgtctaatccgacaattggcgagcgtagaaccgccactaacggaatatcttgatatggattatcgataatactgagtagtgccatcatgattcgaatctcagtggtttgaaaataattctgggcatcattgaccacaacgggaatgtgataccgtttgaaaacatcaataattgttaaattatgattacgtgttggtactagtaacgccacgtcgctgtatcgaaacggccggtattccccattagcacgttcatagattggcttatcttgggccttaagtgccaaaatcttttgggcgaccatcgtgatactcccaacggcaggatcatcaattgaaaaattggtttcatccgtggagacatcttctgtcgacttgtcagtttccgtctggtaaagtaatagattcgtcgtttgtggcatatcggccggataatccttgggcccatacttgaggtaagccgcttcatcataatcaatttgcccgaccggcgcgtccatcagctgactaaagattaggttagtcaaatgatcgacattcgccaccgaccggaagttttcagctaatacgattcgttccccgtgttcgggattcgtcccaaaatcgtgatacttgtgcaaaaacaataacggatcagctaatcggaactggtaaatcgactgtttgacgtctcccaccatgaacatatttcctggctggtcgcgcgccaacagctgcaaaatactttcttgcaaagagttaatatcttgatattcatcaaccataacttcttcaaattgggcccgtaactgcgccaaagctgcctgactactttcattgtcactcgttaagatttgcaacgttaggtgttccaaatccgaaaagtccaggacgtgtcgccgccgtttttcagctgcaaaagccgtcttaaactgcttggtcgcatccactagctcagtcacaattgactttgcccctaccataatatctaagacttgctgctcatcggccgcaaaataggtctcgctaagggtggtcatttgtttcttgacaccgtccacaaatgtgcccatagttttggcccgcgcagtcttctccggctcgtccttataagtttttttgagagctccaatcttgaaagtagcgacttgagtacgtaactcattccaacttgccgttgccaattgttcacggagcgtcgtcagcgttttttgtgctgtagcgagtacctcaagcgttttcgggactaagtcagcatccgtcgcaactttttgtgcctgtcgtaatttcatttgcatcccatcgacttcattaatgagcaatggtaataattgttgttgataaaaggcactggccgttaacgcttcctcatccacctgataaggttccggtaacttgctcagccagccttccggatccggggtcgactgggcaaaatcaaataaccgaaaaatcaatcgactgagaccatcatcacttcgatcattagaaaaattcgctgttaataagtcaaataacgtaccatcttcatcatataattgttcacgaacactgtcccaaacctgatcacgaatgagtaacccctcagtgttgtccgtcaataggcgaaaaacaggatccaaatcaataacgtagtaataacgctgaatcacgcggagacaaaaagcatccaacgtactaatgttggctaccccgagcaaatttaattgctgccgtaattgccgaatcgctggtgacgccgtggtttgcgccggattgtccgtcattaactgtgagattcgcttattgatttgcgattccagcttttgtttcatatgcttggcagctaagtttgtaaacgtcaccacgagtaactggtcaatattcgtgccggccaatatcttgcgcataatacgttcgatcaatacggtcgtctttccagaaccagccgaagctgaaactaacaagttatttccctgctgtgcgataacagcttgctggctaggtgtatagtttgtaccctcactcatggttttctccacctttctgtgtcttcagtaaatcaagaacctgtttggctgataatggcggtagatcccgataagcattttctgccaacattgcatcaaactgcataattgatagatacggcgaatattgtaaagcagtcgtcttatcgttcagccgaattggatttagttgaatttctccagcgaaaatcgcttcagcagctgcaataatcaattgactattatgctgtaataatcgttctaactggtcattcgtcaccagtgaagctgcacgccccccactatacgacccatcctttttacgtgcgaatgggtaaactttcgaggtcccgttaccttgttgtagttcgctatctaaatgttccaataactgcggatcatcgagcaaaattcccttatacttgttcttctttaggagtgctgcttcaaaaccgccctgaatatcttttggtttcagagttggattttgaatgtgcatgtaaagtgcgccagctaatttaaccgcagcttgatcagaaccgactaaagcttgctcgttatgcagcacagcgtccaaataagttaacatttgcattgcgagaccatagtaagcctcttgaaaatcaaatttatgttgggatgacttataatcgacgattcccaggtaactttgatctgccacttgaatttggtcgagacggtcaatcttcccccgcacgtgcacactatgcgttgcatcaatttgaaaatcgagcgcttttaatccgtgttccttgccaacgttaccaaataagacctcggtttgcttcggttcagcggctgacagtttactttgattgcgaatcgcaaatgcaatctgccggactgtgttgattaactgccgttgcaagtaagccatccggttagaactcgtcaaaattgtaaactgtggttgatctaagatttgacgggtcacagtctctaaatactgtcctaactgctgatcactggcttgggccaatgggatttgatcagaccgtaacgccttgatgagcccatctaagacagcgtggaaaaactccccagtactagcagctgataactcgaacacatcacgctcacgcagtttgagcccatatttcaagaaataagcgtactgattacgataaaattcttctagttttgaaattgacgtataaatttgatgcccatacaaagcctcaacgctggctggtgtcagcttgacaggttgattgcgatagcttaatccagccatcaattgacgtgctagctcaccgaattggggatcacgcgtcaattgttgccgtaaccacacccacaccggagcaggttgtaatggtgcgccaacacgattacggtcagtattcgtcgttaacacatcgcggtaaacctgaatcacatgactaatcgtccggcgcttagtcccaacaaatggccgcgcatcggcattagtcggatcaggcgtcccaagataagtatgttctcgcaaattgaactggcgttgaattcgccgcacatagttggaccaatttaaatctgtttcttgatcatcttttaacggggcgctgaaaaacaagtgtcgacgggcacttaaaaaggccaaataattcagacaactttcatcaccgagctgaacgacagctgaatcatttaaatagtggtcaccatctaacgaactgagcgttggttgcaaattttctttatccacatcactcaataagttgttcgtcataatccggtcaggcatcactaaatcggttgccccaaccatgaagacaactttatggtcctgactttgaaccattccgctctctgaaattaacacctggtccaacgtcgacggaatttgcgagtaactagcaccttcaaagcccgcttgtaatagtgccaaaaagtccgtaatttcaaatggctctgcacctaaaatcgtcacgtattcatctagcatcccacagaaagtttgccaggtctgctcaggctcggcagctgcccggacatcttggcgatccaaggcttgatcacgccaagctaatagctggtccgtaacgccctggcttgtcaaaaagttgaccagcaatgtcacggccgctttgccatccggtgcttgccgcatttttttaaaaaacggtggtaacgtttcagcaacaaagtgatgaatcaagttgatttgtcgcgaaatttcagcattttggtccgtctcgaccccggcatcaccctcggttaattgaaagtattgccaatcttccctttgtacccaccgctggccgtgataaccacttttaaggataaagttttcggtcagatctactgcttggcggtaggcttgccgatccatcggttgcccattgatatttggcatcaacagctcggttttcaacactcgcataacatcacgatattgatactgctgtgcgtcgatatcaaacaacgcgttaatcaactcaactaacggatggtcggccattgaacgctgtaaatcaacaaagtatggtatttctaattcatgaaaagtcggcgctaacatcgtttggtaggcatctaagtgccgtgtcatgatcaagaagtcccgataatgataatcgtcggcgggatcggcatgttttttcgcgaccattgcccgaatcatgcggccaacttgtgccaattcggtctgtcgactatcggtccggaataaatgcacattcgtattcggctcctcgtaaccggtagccgcttggggctgaccacgccaaaaatcatcgagagccactaagccgggagccacgcgcggcgtttcagcataaatatcttggctaaccggaatctgacgaatacgggcatactgataaagccgataataaagccgaccagattgataaaacagcgtgccattttctggcgcccggtcaacgactttgtgatcgagcatcaaactgattgtcacgtccgcgccctgttccagcatagtcgtgacgattccctgttcctgggccggtaattgggcaaagccagcgagttccacataaacgtgcgttccgtgcaagtcttgacgccgtaagtaagcattcaattgaacgagaatatcagcgggcttaagatacttatctgcagtcgccgccacgaagtctttgtaaacgatcgccagatcatgtagcttagcctgcaagtcacccgcctgagcattcgctgccaattgaaccacatcttctggttgcaaattagcggtctgtaactcattaatttcacgagctagttgagtcacaaaacccgtttgcgagatttcaccaccaaacaatcgcagctcatcggcatgtcgttgtagaatgcgatataatagcatgtcaatcccagcagcggagagtcgtggtacttgataagctgcttcgttcttcatcaagtaccaagcaagacgggtaaatgaaaagacctgaacctgagtctgggcatacaaatctggttgcccaaatgcctgtgccaagcggttcaacacgtcaacttcagtatcgaacttaatatggttcggtaccaaataaaaaaactgatcttgtggcttagccatcaaggttgccactaactgcgccaccatagtacggcgatggtccatcttggctggtcccaatacaaattgtaagctcaccactaattcctcctctgaactgaacaaacgttctcattaagttagtctcattatcgcatatttaaccggctaaaaaaacacctaacccgtaagttagatgtttattatcgcgtccattaaataccacgttattcagccaggcgacccgtgtgctgcacgtcttaattctcaacgttgacggccactgctgccagatgtgcgtcggatttataatggcttatcgtgcccggcatccagtaccgttttgtcatcctgatttgaaattttagaagctttaacgaacgtggtcacggcttaatgtggtcaactcgcacggtcgcttattcatccggctgcaagtctcgacctcaaaacaccttaccgatcacccggtgacactcgccaatcctcagagtgcttaaaagacgcgaattagcacaacccccacaatcatgacgagcaagcccatcaactggacccccgaaattgggttcttttttgaagcaaaccagccaaattggtcaatcattaaactaccggccatcagtccgactaaaacaatgacgaccgctaaaccagtgccaacgaccggaaccaagtaaacattacccaaaacatacagcgcgccaatcatgccaccaatccacacccaccaaggattaggcgtcttagttggcctaatcaatttgaattgaggtcgcaagactaacacgatgacgatcagccccagagtaccaactaaaaaagaaacaaatgccgcgtgcactgtggagccaagcacccgacctaggtgcccattgaccgcagtttgcatcgcactgagcattccggcaaccacacctagtgcacgccaaattccaaggccactttggtcagtgtcagtagctgtatctttttccgctgtttcagtgattcgattatgccgctgttcgagccacccctgagccgcaacggtgatgatgactcccgccaagactaaaattgcacccaaaaatcgggtcatcgtcaatgtactttggggtgagtcgaaccaaccaaaattatcaatcaatagcccggccaaaatttgaccaagcacgggcataataacggtttgaacactacccagcttcggaaacaacaagatattgccagttaagtagacgacccccaacagcccacccagccaaatccaaaccggttgactcgtaaataacgtcgtcgaaaatcctaaagtatggacatcaattagtgtcattatcgccaaaaacaacgtccccacagcaaaagatattagggaggcaccaaatggagatcccactgaattgcgcaatcgcgaattaatactcgtttgcattggtaacccaatcccgattgctaagccaactaaaattgctaacatcgaatattccctcatttctttatcttgtcttaacaatctgtcacaggttaatattagcacgagccggtaactaaaatagtcatgaaaatcgtctggataatccagcttaattttcatgactattttaaatatgccagccatttatggcgcgtaatcctaatcagtcactccccagtgttctgggtcctgacgccacgtatgcagcgaagctaattcctcgtcatcaatgtaatctgcttggcgagcaactttgattagttcaggatagttggacaaactgaacagcggtaatgacacagcggcaaaattttgcgttgccgcatccaaggcataactgaagattgccccaacagcctgaatatcgccacctgctgcttgaacggccttggccgcctgtaacacactgccacccgtcgaaatcagatcatccagcatgacaactttttgaccgggctttaacactccttcgatttggcgtccagcaccgtgatccttgggtttagcacgaacgtagatcaatggtagatttaacaattccgccacccaggctgcatggggaatgccagccgttgcgacccccgcaatcacttcggtcgccgggtattcacgcttgatgatggcggcgattccgtgcgcgatatgctgacggaccgccggataagaaatcgtcagccgattgtccgtataaattggacttttaatgccactggcccaggtgaacgggtcgtttggtcgtagtgtaacggctttaatcgtcaacaaatcagtggcgatagttgctgcaatttcactcatattagttactccattctgtcataatatctcggtaagcttgaactggttctgcagcctgcgtaattggccgcccgatgacgagaccgttgctcccagccttagcagcggcagccggtgtcatcacccgttgctggtcatctgactgcgccgacgctggccgaattcccggcgtaattccgagaaaatcagcaccgacggccgtatgaatcgcctgaacttcttgggcggaacaaatgacgccatcacagtcactcgcccgtgctagtttggcataatgcacgacactcgcccgaaccgttcccatgatttgctggtcctgattcaaaatagcttgattagtcgaagttaactgcgtaatcgctaataacttgggggcagtgactccagcggccattgcacccgcgaccaatcctcgtttggcggctgaaagcatcacgtgcccacccgcagcatgaaccgtcgtataggttacccctaaccgcccgatcacccgcattgcggattcgacggtattgggaatatcatgtagtttcaaatctaagaaaaccgcatggccgcgagcttgcacgtccgtcacaatactcggtcccgctgcataaaataactccatgccgattttgacagtgacatgtaaatcagccggaaattggtctaaaaaagctaaggcccgttcggcggtgggaaaatctaacgcaatgataattggtcgcttcatccttggacctcctgaatcaacgcttgcaagctggtgatcccgtactgatccattgccgccggtaatccagcaataatgtctgtacaagcagtcgggtgaccatacgttgcggccccaacttgaacagcatttgcaccagccaggtaaaattccaacacatcagccggcgtgaacacgccaccaacgccaataatcggcaacttggtatgttgacgcacgtcatggatcatccgaacagcaagtggatgaatggcttttccagataaaccgcccgtaccatgcgctaagatcggttgacgtgtggctaaatcgatgcccatacccgttaacgtgttaatcatcgtcagtccagccgctccaccagcttcggcagcgagtgcaattgggacaatatcagtgacattcggggtcagcttcatgaaaactggtttatcgaccgcggcaacaatcgccttagtcaacgccgttaccgtcgctggatcagttccaaatgctaggccgccatggtcgacgtttggacatgaaatattgatttccaataatttgacgttaggtgccgacgccatttttcgtgcgactgccacgtattcatcaaagctcgcccccgcgacactcccaataatcggtaaatccggataatgagtcgctaaccacggtaatttatcggccagcacattgtcaattccgggatttttgagtccaattgcattgagccaccccgcggttgtttccgcggtcgttggtcgtgggttgcccgctttcggttcggcggtggtcgacttgatgaccaagccccccaacgcactcaggtctaactgttgagccatctgttgaccatatgccgccgtaccactagccggcataaccggatttttgaacgtgacaccggctaaatttactgttaatcgtcccatcgttttcctcctatgatcaagcttatcggcgggtgtcctgatttagagcgcctgcgttacaaatgactgtgattctcgtacttgcaaaattgccgcgaccgtatctaaggccgtaaacaatggaataccgtgcataattgacgtgtttcgaatcagggtaccatcattttcagcctgttcttcatccgaaaccgtattaatgacgacttgaatttcgccagcttccatgcgatgcagtaaatcatgctcgccactatcgatcttgtcgacggtcgtaacgggtaacccgtgtgtggtcagagcagtcgccgttccccgagtcgctagcaattggtagcccaacgcatggaaccgcttggctaacgccactgtttctggcttgtcttcatcccggacagtcaaaagtacgttaccatggctcggcacgtgtagcttagccgcttcaaaggctttgtaaagcgcctttgccatcgtgacatcgctgcccatgacttcacccgttgacttcatttctggtcccaacaaactatccacacgattcaactttgaaaatgaaaagaccggcgctttgacgtgtactaagggacccggtgtgaccaagccagtctgataaccttgttcagccaatgactggccaaggattgcccgagtcgcaacttgagccatcggaatgttcgtgaccttgcttaagaatggcaccgtccggctcgcgcgcggattgacttcaatcacataaacttggtcgtcgtggattacgaattgaatgttcatcatcccgacacagttgagcgcaatggctaatttttcagtataatccacaatttgtgcttggaccgccgccgaaagtgactgtggcggataaacggccatcgaatcgccagaatggacacccgcccgttcgatgtgttccataattcccggaatcaagactgtttgaccgtcacaaatggcatcaacttcacattccttcccgaccaaataactgtccactaaaacggggtggtcatgcgacaccttgaccgcgttatgcatgtaatagtctaagtcggtccgcttcttgacaatttccatcgcccggccaccaaggacataactgggccggacaaggacgggatagcccaacttatccgcaatagctagcgcggttgcttcatcacttgccgtatcaccagccggttgtggaatagctaaagctttgatgaccttatcaaattcgtcacggtcttccgcacggttgacatccgccacactcgtccctaatattttgataccatggtcagccaatggtttcgctaagttaatcgctgtttgaccaccaaattgcacaatcacgcccactggtttttcaagttcgatcacgtttaagacatcttcaatcgtcagtggctcgaagtacaatttgtctgatactgagaaatcggtcgagacggtttccggattactattcatgataatcgcttcatagccagctttttgaatggctttaacggagtgaacggtagcatagtcgaattccaccccttgcccaatgcgaatcggccctgaccctaacactaaaacggatggacgtttcgtgacaatactctcattttcaaactcataagtgccgtagtaataaggtgtctccgaagcaaactcaccggcacaagtatcgaccatcttataaacgggcgctagtttgtgcgctaagcggaagtcgcgaacctgatcgattgtttcgtgccaatagtcagctaccgtttgatcggcgaagccattgcgtttagcaacagttagtgtctctatgtcatccgtatgggtacgcaaagcttgttcgatttcaataatgtgtaatagtttatccaggaagaacacgttgatcttggtgagttcggctaattcatcaatcgggtaaccgcggcgaattgcttccgttaagtagaataaccgatcatcctgcgcatgaatgagcttatcgctgagtacatcatcatcaacactacgcaaagcgggttcttcaacgtggtgcaccccaatttctagtgatcggaccgcctttagtgtggcttcttcaatattgcgcccaatcgccatgacttcgccggtcgccttcatctgagtgcccaaacgacgatcagcatgggtgaacttatcaaacggccagcgaggaatcttgcaaactacatagtccaacgctggctcgaattcagcgtaagtggttcccgtcaccggatttttaatttcatccaaatgcaagccgactgcaatcttggcagccatcttagcaattgggtaaccagtcgctttggaggctaacgctgatgagcgactgacccgcggatttacttcaatgatatagtaattaaaactattcggatcgagggccaactgaacgttacagcccccctcaatcttcaacgcccgaataatcttcaaagcagcatcccgtaataattgcacttcgcgatctgctaacgtttgaacaggtgcatagacgattgaatcaccggtatgaatccccacggggtcaaaattttccatattgcagacgaccatcgcattatccgcagcatcacgcataacttcaaactcaatttctttgtacccggcaatactttgttcgatcagaacttgggtcactggtgataacgccaacccattttcggtaatgtcgtgtaactgttggggcgtctcggcgatgccaccgccagtcccccccatcgtaaaggctggtcgcacgatgaccggataaccagcttgctcagcgaaagccaacgcttcgtcaaccgtccgcgcaataccagaagctggcacgggttcgcccaattcttccatcagtgccttaaactgttcccggtcttccgcctgatcaattgcgctgagcttcgttcctaacagttcaatgtgcaactcatcgagaatacccgatttagataattccatcgccatattcaagccctgctggccgcctaaagttggcaaaatcgcatccggatgttctttgcggagaatctgtgaaacaaattcaagtgtaattggttccaagtagacctggtccgcaatttctttgtccgtcataatcgttgcggggttagaattgaccaagaccacttcataatcgagttcttttaatgccaggcaagcttgtgtcccagaataatcaaattctgcggcctgaccaataataattggtcctgaaccaattaccataattttatgaatatctgtccgtttaggcattgaattggcttcctttctgggttgcttgattagccgccatcaaatcaataaattcgtcaaaaatatgatcagcatcgtgaggacccggcgctgcgtccggatgatattgcacggaaaaggccgcgtagtcgcgatgccgcaagccttccacggtaccatcattaatctcctcatgggtgattaacaagtcagtctgcgctaatgaatcccgatccaccgcgtaaccatggttttgcgacgtaaaatcaatccgcccagttgcaatctcacgaacgggatggttaaacccacgatgtccgaacttcatcttgaacgtgtccgcaccgtttgctagcgcaaaaagttgatgtccgagacaaattccaaatagcggcacatgtttttccacttctctgatcatctctaaggctcccggaatatctttgggatcaccagggccgttcgtcaacatcacaccatccggattcaaagccatgatttcactcgccgtggtattgtacggcaacaccgtcaagttgcattgacgctttgctaattcgcgtaaaatcgaatgcttcaacccaaagtcgacgacgaccacgttggggcctgtcgctgggttgggataggcgttattcgttgagctctgggcaacaacggcccgatttaattccgtgactttgagccggtcaaccgtatctggtaagacgttatcgacgatggtggccttcatcgcgcccttcgttcggatatgtttagtaaccgcccgcgtatcaatatccataatgccaggaatcgcattctgttttagataatcgtccaacgactgagcattacgccaattactggctcgtcgggcaacttcgtgaacaacaacgcccttacaagttggcttgattgactcatggtcatcccgattaatgccgtaatttccaatcaaaggatacgtaaacatcaagatttcgccattataagactggtctgtgatcgactcttgataaccactcatgccggtattaaagactaattcaccaaccgtggccgttgtcgcaccaaaccccgtgccggggtaaatcgtaccatcttcaagtactaagtatcgtttcatgcttgcgtttcctttccatatgccaacttaccgtcaactagtgtcattaagacgttgccataaacgggccaaccgataaacggggaattgtgccccttcgataacatggtggccgcttcgatttcatattgatgatctaaatcaataatggttagatcagccggtgcccccactaccaaccggccggctgtatttaagccaaatagttcagccggacgcgtgctcatcagttcaattaaacgaccgagcgtcagtaaccgggtcttgaccagcgccgtatatagcgtggcaaaggcagtctcaatcccagtaatcccgaaggctgccgtcttcatgctgccctgtttttcggcatcagtatgcggcgcatggtccgtcgcaatcatgtcgatcgtgccatccaacaatcccgcaactaacgctgcgcgatccttggctgaacgcaacggtggattcatctttaacatcgggttatccatcgtaatatcttcatcacaaaggagtaaatgatggggcgatacttcacaagtcacgttgatgccagctgctttcgcattgcgaatcacgcgtaaactttccgccgttgagacgtgacaaacatggtagtgaaccccactcgcttccgccaacatgacatcacgagccacttgggccgcttctgaaacattattgataccaggcaatcctagccgatcagcaacgggccccgcgttcatcacgccatgatgataaagcgaatcatcctcaacgtgtgccgctaatggcaacccaactttagcagcaccttgcatggctgcaaacatggttccggccgtttgaacaccggaaccatcgttactgacggcaaaggcccccgcagctttgatgccggcaaagtcaacgagctgttcactagtccgcccagtcgtaatgctggcatattgtgcgacgtgaacatgtgcttcctgctgattacgcgccaccatcgtcgcgacccgctcaggtgtatcgggtaccggatccacattaggcattgctccgaccgttgtgaaaccgccatgcgccgcggctaacgttccggtcgcaatcgtttccttcgctgtttgaccaggatcgcgtaaatggacgtgtacgtcgacaaagcccggactaacaaagtgctgatcggcacaaatgacgtgatccgccggtccaaactgatcgtgcagttgatgcccgatcgccttaattcggccctcggcaatcaggatatccgttgtttgtaactgccctgcttgccacacttgagcattcttaattaatgttgtcatgcgttaaacctccacttgagttgctgaaattaatccttgatgagcgaggacgctcgccaccattgccatccgaatataaacaccattcgtcatctgctgaaaaattcgtgattgcggcgcttcaactaagtcactcgctagctcaacacctcgattaacgggggccggatgcatgataatcgcatgcttgggcattcgtgcggcgcgctcagctgttaaaccatactgttgatggtaggcagacgcatcgaaggtctgattgttcacttgcgataatcgttcgtgttggacacgtaataacatcatgacgtccatcgttgcgactaactggtccatcgtctgatattcgccgtatgcttcaaagtcacggccataccattctttggggccgccaaagtaaacctgggctcctagttgcgtcagtaacgccatattggaacgggccacacgtgaatgggccaagtcacccacaatagctatctttaaaccatcaaaatgaccaaattcttcataaatagttagcatatccaacaacgattgtgacggatgttgcccactaccatcaccagcattgatcaaactcatgtcaaccccggcgtcgagaagtggttgataataacgatcgcgtggatgccgaaccactgccaagttgacgccaatggcttcaatcgttttcaaagtatccagcaagctttcgcccttagtcacggaactagtctttgggtcaaacggaatcacctgtaatcctaatcgtcgttcggccatctcaaaacttgtatgtgtgcgggtgctattctcaaaaaataagttcatcgcaaacgttggctgtgacagttgtaccgttttcccattcttgaaagcttgggccaacttcaagtaggccatcacgtcctgattactaaattgttcaacactaactaggttttgactcgttttcatggctattgccgtctcctttgtatataaaaaaagtctagcttccgcaaaaatgtttgcaaagaggctagactccgattaagtggtcacgcatggccaaaccgtttcgttcctctctggaaacaattaaatggttttattcaattaaatcattcttctaatttttcaatactaattccatcatgtccgtcgtgttcttcaagggcgacactgacttgttcatccaaggccgttggaatatttttaccaataaaatcaggccggatcggtaattcacgatgtccacgatcgactaagaccgctaacgaaatctttgcgggacgtccatggtccatcaaggcatctagcgcagcccgaactgtccgacctgtaaataagacatcatcgaccaagataacgtgtttgccattgatatcaaccggaatatcagcaccatttagcttcgcttgaccggcaacatcaaccgcatgatgatcatcccgatataacgtgatatctaacgaaccaactggcacgtcaacgccttccaactgtttcaatcgttgcgctaaccgctgggccaaaaaaatcccacgagtcttgataccgataaataccaggttaccaacacccttattctgctcaataatctcataagtgatccgcgtcagcgcgcggcgcatggtcattgcatcaacgacttctcgtgccattagtttgtcagctccatttctgtaatttcaccttaatccacggggtaaaaaaagagtcaccccgttttcctgcgaaaagcgtgggagaccctacatgaccgttccccttgttagcctcacaggactaagttaaaggtgcttgtttaattggactaagtgtaacgaactccaccacaactgtcaaggactaatcaacttaagtcgcgttaattatctgacgactttggtcatttgccctttatgttgacaagcatcattcaggaacctgacgagttcaatagatttccaatcgtgacacgtgatcgtcttattccggcctctaagaataaatgatgagcggtcgcctaatattagtaccattggtcgttgaatccgttgatattagaacttcaattaaagctgggagaccatcaattcactttaatgactgtttcaatcttaacgtgctaatttagcaacaaatggtctatcaaaatatcattatatgcgaaatctaccctttatgagcaacaacaaactcagcaaaagttaagtccacccatcacttgaacaccacctcgactgaaaggcgttgctgacaatactcagcactggaagccggtgaagttcagacgggttgaaactgaagattatctcaacggcaacgttgaggggtgaactttcacttagctaactggaagtctcaacccgagcgaatcccgtttctgtatgtcggcatccaacgccctaaccaggtgaatttacactaaacaaaactttcttcagcagtcctgcgccggctactcctgcgcttaggataaacctttccaatacttaaattccttaacccataacactggttcgacgcttcatttgtttttaatctatttttcatttaattatagtcaaactgccaaattatcggtatactacttgttaaagataactaattttagggggacttaccatgcgtttacaaacactattacaaacaccatcaatgcaacatatgcgggtaattgcgggtgaacgcggtctcaaacgcgaaattagtaatatcggaatgatcgagtcacctgacattgctgactaccttgctaatggtcagtttttgattacgaacggctatcccttcgtcaatacaaccaccgacccactaactttgatcaaggcgatgcacaatgccaactgtgctggtctcggatttaaggatcatcgttacgttgaccatttaccaaaaaaagtgattgaattagcgaacgaactcgcttttccaatcattattacgcccggtgatgagttgatttctgaaaccatgcgcaaaatgctgagcatcatcttaaagtcacaaactaatgagctcagtcgcatcgtcaaggcaaaccaaacactagcggatttgttgctcaaagacccaaccaacaccacggtcttgaataaatgtagcgagctaattcatcatcctctcttcttaatggatagtcattttcgggtggtcagtgcttcccaagatttaccgatgacccgcaataccttgactgattttttacgcaatcaaaccgatatcgactatttcaacctcaatacccgcgtcattctcccttaccaaacaaatgacctgaccatcatgccactattttcggcttataaggaaaataaggcctttgtaggcgtcgtcgacttggacccggccaactcaactgatcagatgctgacgcaagtcgtcttaaacaccttgagtttcgtcaatggtcgggtggacatgttaaacgaatccgcattccgcaaccaaagtggtttctacttaaacgtaatggatggcggtatttcaaacgacctcgtgaataagactctgaaagcccgcaatattgatccgagtacgaagttccactgcgccaccattttagtcacgactaatcaccaggccctcttaagtaaccatctcttggaacaggttcagcaactgacactgtggtttattaaagaataccaagcatccgtcattgttttttcattaaagcagcaattggtcttattaatcaatgaccagcaaaatgcccagcactttctgaccgccctcgttcaatttattcagccaaagttggacagacaggcgcgtttgattgctggttacagttattcgactctaccactaaccgaactcgcaacaacctataatgaagcggcagaagccttggcactcagcaaaaacagtccccacgcagtcacgatctatcggcccaagtacgtcaaggaactaatttcactgattccacaaaatgaagcgcgatcgtttgtcgaacgggttttaggtggactcgtcagtggtgtcagtgcgaatgaacaacttaatctactcacgaccctgtatggctatttttattaccatcaaaacattgccgaagtggccggccacctagatattcaccgcaatacggtgatttaccgccttaaaaagatcgaaaaaatgctaacgttgaacttggacgatcctgaacagacccaaacactagaaatggcagtgctactttggcataatcaacaatcacaaaagtgaacgttttcattttcatcttccaaaaaaatatcgttttcacgaacattaatttattcggctacatttgtattcggttttcatctgtgctagaataagtctcattcaaataagtggtaattgcctatataatgtcatgatatggttgacgagtttctacccaaccccgtaaaggttggactataagcaaacgaggtcatcccgtttgccggggtgactttttttataggcaaatcagcttaatcgagagaggaagattgatttgaaggaagtatccgcagcacctaaaattaccaatgttaaggcggccattttagggtttcaacatctgttagctatgtattcgggtgatgtgctcgtgccattattgattggcgcggccttgcatttcagccaagaacaattaacttacctagtctcaatcgacattttcatgtgtgggatcgcaacgttcctacaattaaaacgtacaccactaacaggaatcgggcttcccgtcgtgcttggctgtgccgttcaagccgtcaatccgttgattcaaatcggtaaaacatatgggctggggaccatgtatggctcaatcattggtgctggtatttttatttttctgattgccggcttattttcaaagatcaagaacctctttccaccagtcgttacgggatcgctaatcacaattattggattcacgctgattccggtcgccttccaaaatcttggtggcggcgacaccagtgccaaggatttcggtaacttgcaagcacttggcattggttttctcaccatcgcaattattttattaattagcgtgtttgcacgtggcttcatgaaatccgtttcgattctgattggtattttagttgggactttgattgccggggcaatggggatggtttctttaaaacccgtcgctgaagctagctggttccatttaccgaccctcttttactttgggaccccgcactttgaatggtcatccattttgaccatgatccttgtctccttaacaacgatggttgaatcgaccggggtcttctttgcccttggcgacattaccggtcgtaaaattgaaggcgacgatttaaaacgtggttaccgggcagaaggaattgccgtcatcctcggtggcttgttcagtaccttcccctattcaacgttttctgaaaatgtcggcgtcgttcaattatctggtgtcaagacgcgaaagccaatttacttttccgctgcgttcttagttgtattgggcctactgcctaagattggtgcgctagcgacgattatccccgacccagtacttggtggcgccatggtcgtcatgttcgggatcgttggcattcaagggattcgaatgttagctcaagtcgatttccgcaataacaataatttactcgtggcagccgtttcgattggtcttggtttgggcgtcacggtgcaaaccaatatcttccaattcttacctggtgcacttcaaatcatgttgagcaacggggtggtcgttggtagtgtagccgcagttggccttaacttactcttcaaccgccacgcagccgaaaacacgattgatgatgaatcagtcggtctcaatgaaacagaacaaccttaattatgacgcttaataacagcggttcacggtcctaatctggcagtgaaccgctgtttttttgttctgctacttaatagccgctctcattctattgattgctttatactgccattttttgctgaatgtcaagcgtcgtaccgatgaagactttttttaaagtaactttctttcgacttggcataaaacttgcccatgctgccgaagagtcatctaaacctggtccattccaaaaacaagccatcgtgaggcaataaactgattaatcccctgttaccctaaaaatcagtatgttatactagacaattgttgaattgttagttttttattaattttaggagtgggtcattattctagaacaattatttcatttgcgtgaaaaccgcacttcagtccgccgcgagttgattggtggtctgacgacctttttagccatgtcatatattttggccgtaaatcccgaactattgggaagtactggtatgagtaagaccgccgtcttcaccgcaacgattttagcggccatcgttggttgtctcttgatggggctagttgccaattttcccgtagcattagcaccggggatggggctgaatgccttctttacttatacagttgtccaggaatggcacattccttggcaaaccgctttggcgggagtctttgttgccggaattcttttcatcctactaacgctctccaagttacgcgataaactgatcaacttgattccaagtgcgctaaaatacgccgtatctgccggaattggcttgttcattgctttttcaggactacaaacctctgggattatcgttgcgaataagtccaacgcggtcgccctgggtaacttgcacagtcccaccgttttgttggcgattttcgggattatcgtcggcatcatgctagtcaccgctaatgtaactggtggtattttctggggcatgttcatcaccgccgcagtcggaatgatcttcgggattattcccctaccaactgggattatcagtggggttccgagcgttcaaccgatttttggtcaagccgtgacacaccttggtaatattaattcgtttcaaatgatcattgtcatcctgacgttcttcatcattggccttttcgatacgtcgggaaccttggttggggtggcaaccgaagccggcatggtggacaaagaatccggcgaagtcaaaggcgttggtaaagcgctctttagtggtgcactcgccacaactttaggagcagtctttggcacgtcaccgacaacggcttatgttgaatcgacttccggcgttgccgtgggggcccgtactgggttatcttccgtcttcgttgccctcttgtttgccatcgccgcctttttctctccaattttgacggtgattacgtccgcggtgaccgcttcagccctgattatcgttggtattttaatgttatcaaacgttcaatatattgattggaccaagtttgaaatcgccgtcccagcctttttcaccatgattatgatgctactaacttacagtatctcagaaggtttggccgttggctttatcttctacccaatcaccatgacggtcaaaggccgttggcgtgaagtaaacgccctcatgtggacgatgatggtcgtcttcattctctactttgcatttgtcgcttagaactgatggttcgctaagcaatgatggcagtctaaaacacccctgagtctttaactcaggggtgttttttagtaggcacggctgcatctaacgcctactagtgtttaagaacttgttgattatggtaatcttcagcgtagacttgggcaaagtcagcaagtttaacatcgcctaatcgaggttgatgtgctcgataatccgcgtaaaaatcgtggtcacgctggtaagcgaccgttttaacatattcccgtgcaaatgcgaccggggttccggcagtcactaaatgatcttgcatgacctcatcaggcacttgtgaaacgcgcaaatccggcattttaagagcctgtgacagtgcggaagcaacttccaaataagttttctcatcactcgcaacatatgtcaccgtttgccccggtgtcggttcggtcagcgccttaatcagtacagttgtaacgtcgaccggcgcaacccacacgttcttaacagccaaattggcatttgtgtagattcgatgactctttttaacggttggcacactgctcagtaaattatagtacattgccgttgggcggataaacgttaagtccacgtctggtaaagcggttgttaacgtttgttcgataatatgatacatgtaaagtgcaccgacttctggtcccaagtcggcccccacgctactcagattcaccactcgttttacgccggctgccttgatcgcggcggcatagatgtccgcttgtcgtttggcagcggtataaagatcatcactcgccgctataccagttaccatgaggtataccacgtcagcgcccatgaacgtcttggtcaaaaacgcttcgtcatcaagtcgaccaatggcaggggttgcgcgaaaaacctttatcaaactactgcgagttgcttgatgactgatgaccgtcacttcatgaccagcatgggtcagcttaggtaccaaggtctggttaatacgaccgattgaacccgttaaaacaattttcattttatgataaccctcttctatacttattaaattatccgtcaaagtcattatcgattataagcgaccactaaaaccccgtcaatcactggtggtttagttggctaaacagtgttgatgtgcggttgcgtgattcgttcataagacaggactgattaacgttaatcaaaaatcatttctatttatcaagagataatttttgttgaaactgtgcaaaattaggcctataatgtcaaaatgtttgacactgtcaactacgacggttagtcgtctttcctgttaccataagtttttcttacggagattatattagatgagtctagcacaattagaaataggattactgtggttgacaggctcaattgcggtcatcttcatcctgacgattggtacttattattggtactcccgcaaacgttccaacaattaccttgaaaatgatgattttaatctacgctactttattcaaaaacaagtcgattttcgtggccgcactaccggctatgaatgtctcctgcgtcaacaaaatactgatggttcgtggtcattaccaccacaacttgactcacttccacttcagcgggtgatcttcctgcttgaagatacctttaaggcgctacctgatgaagcgattacgttatcaatcaatttagaatacgaacaaatcatcagtcccgaattccgttattttgttcgctgggcaattgcgaacatcgaaccgatgcacttggcaattgagtacacacctcaataccaaccgcgtcgtatcaataaacgcctatttcagcgacgaattcgtgaagcccgcggttacggcatgcagtttggaatcgataacgtcggtgcaagtctagccaatcttaaaaacattcagtggcttttaaaagatatcgacacgctcaaatgctcaatgcgctcatttcgcaaggaagacccatccgtctggctggacctgaacctccaattctggaatcagctctctaaggaaaacaatattgatctaattctaatgggaatcgaaaatgaggccgatgaacagctcgccgagcaactgcaaatcagcattcgccaaggctacttattcggccatccaatcaatccccagcaatcaaccacaaaggagaaccacgatgcctaaaccaaccactgatgatgttaatcggcaacaactatactctgatgcgtactttgacactggccattggggactcaagattcgccaaacgatcgttggtatcgtgggttggatcgcagtgattgtgcccatcaccgtgacagtcctttccatttggtcaagttataatccacacattccgcgtttctggcactaccatgaaggtcttttcgaatttaagttcatcggtatcttactggccttttgctttgcactcgcatccctttttgcagtgaccatgaccattatacagaatcgtaagcgtgaacgtgtcgttgaacagtggccaacctttaatcccattaatcagaaaaaacggcagcaactgctcgctcagttcatggcggaccgtttcggcaatgccgaatttcgtgaacatacccgccactaccgggtcaagccagaacaaaatctcgatactaatcagattcagcaactttatcaacaaaataatttagacgatattaacgattaaccagggggcgccatgacaaatatttttattgaccacatattcgccgcaaccttatttaaatcggtaatcaacatcgcactcctgattttatgcctctaccccatcgttggctcttttttctggttcgccggcgcgctatcctaccgctttatcaagaccaataagcgtgatgatgactggcagtacattccggctgaacagcaaccaatgattaccatcatgatcccggcgcacaacgaagaagtcatgattgaagaaaccatcacatacttatttacccagctcaattatacgaactacgaggtcctagtcatgaacgatggttcgactgacaagacggccaccattattcaacggttgcagtccgtctatccacggctacgaaccgttgaaattgagaaaaacaagggcaaggcccacgccttcaatattggcatgtactttgcccagggtgagtatattctcagcaacgacgctgatacgattccagaaaaggacgccctgatgaagtatatgaatttcttcatccatgaccgcgatatgaatacatccgccgtcaccgccaatatggatgttcaaaatcgaacgtcgcttttaggtaaatctcaaaccgttgaattctctagtatcgtcggtgttatcaagcggagtcaaacttccatcaacgactctatgtacgcgtatagcggggcaaataccctctaccgcaaacaatttctaattgacgttggtggctttcgacaaaatcgcgcgacggaagatatcagtattgcctgggatcaccaaatggtgggcgccgtcccgcggtttgcccctaacatcgtcttccatatgaacgtccccaccacaatccgagacctttatcatcaacgcaaacgttgggcacagggtggcacggaagtgtggttaacgaacattaagaaattcattttccacccaatcgttcatcgctatcaactatcaatgttcgtcgattcgacgttgtcaatcatctggtcctttttcttcgtcatcacttccttgatgtttttgattctgatgggttacttcctgataaccggcaattttgaacgagtctaccacggcttgatgttgtcatttgtctttgttagttttgaactattggccgggttcatgcaactgttagcggcactcctgttggaccatcatggtgcgaaactaaagtactggttcttcgccccactctacatgttattttactggatgatcaatcctatcaccgtcgttgcaacgtttattcctgcactcaaaaccattctgggctttggctccggaacgtgggtcagcccgaagcgacagtcattgcagggtaaaaagtaaaacggtgtcgctattaacgctttcaataatcgataacgggtctactggtgcgagaacttgcaaccagcccaactaaaaacgtgcacttacctgagtgataactgactcaggtaagtgcacgttttaatattaatcccttttgatcgttttcttagctatgcaaatggagctgcccagactacgctgagtaacaggtcccatgtgtcacgtgccactgaacgcagagatcggcaggtaaatcacgaacggcctcacgacttacctgtgtgccaagttcagtaattgatcgcccttgctgactgccgaggccctggcgattcagctgaatcttccgcgcaccaactcgatacaagtcactcatgatctggtggtaggctgcggccaagtcatgcaccatttccgtatctgattgatagactcgattaagtgcgcgcgcattatcggaccgtttgagttctgccaagcacagctcgggagcgggcaagatttgtttatccacagttccaccactgatttgattgcgcatgaattcaaaatgcgcaacggcaggatggttgaagccactgattttaccggtcaacgcgagcgccggtaccgaacctatcccggattgggtgatgccttgtagcccccagaaaaagttaaagtgccaccaatttagattatgcggcttatcaaccggtttccgaatatgatgcataaaagtagcgtcctccatccgtttaagtcccgccgcgttaatattcagcgttgttgtgccccgatgcaaccctttttgagaccgcattgccatttgccaaccatgtacacggtgcctaaccatcatcatcaatgtgccaaattccatgcccgtttagcctccaaattaattgcattctgccaatataaaaatcgtcccctactgcttaaaaaggacgatttcaacgtttgggtcagcctttaactgccaacaccaaccattattcttttatgacgaatttaagtaatgtttccagcatagaatggtgctcaccgaatgtcaagcgctaatcgtgggacgctgtcatccccttaacgccaatatcagttcggtacactagatcaccgactctgagttggtcgatttgttgataaacagcccgctgtgctgcgaccaagctcggggcacttgcggtaaccatcatcacccggccacccgcactgactaattgatccggggtacccgcaacgctagcataatccgcaccagcaaccgtcggaaccggtacaccggcttcagttggtcccggataaccgggagcagctagtacgacgccaagataagttgccgtcgtttgccactgcgcgtgtggttgccgatgttgcaataagtcgacgatgacttgataaaaatcactctgtagttgtggtaataagatctgcgtttcaggatcacccagtcgcaaattatattcaataacttgaacaccggtcgcagtcaggattcccccaacatagataaccccttcaaagcttaacccatcggctttgagacctgcaatcgtcggttcaataattgtcgcaatcgtttgatcgataaccgcgggcgtgatttgcggtactggtgaataggcccccataccacccgtgttcggtccccggtcatggtcctgtaaccgtttatgatcttgggcggtcggtaataacgcatagtgctcaccaccaaccaaaaccatttgggaaaactcaaagccagcaacgtagtcctcgatcaagaccgtcgaactagttttaaaggccgtcttaatcgctgccgcggcttgttcataactcgtcgcaaccgtcacccctttaccagctgccagcccatcgactttgataacttgcggcaccgcttgttcatgactataagctagtgccgaatccaattcatgaaattgccggtagtcggccgtcggaatgtgatggcgactcatgaaggccttcgcaaataccttagaactttccaactgtgccgcagcttggttggggccaaagatagccaggccggctgcttgaaagtaatcaacaatgcccgcggctagcggtacttcgggtccgacgaaggtcagggtaaccgtattggcccgtgcaaagttgaccaaccccgcaaagtccatttcgtcaatcgctagtgtccgaataccatcccggatcatgcctggattaccgggtgcacaatagacggtactgacttgcggacttgccatcattgccttggcaatggcatgttcgcgaccaccaccaccaactactaatacgtttgccatgcacgcacccatcctttcattaatgccggaagtgtcgaacaccagtggtgaccatcgcaataccataacggtcggccatggcaatcgaatccttatcacgaatactaccacctggttgcacgattgcacgaatgccgtgctgcgcagcatattcgacgcaatcatccattgggaagaacgcatccgaagctaggatagcattttcgtagccagcttgttgcatcgccttaccaatggcaatcttagttgaatcgattcgattcatctgaccagaaccgattcccaatgtccgatctgcggtagttacaacgaccgcattgctcttaacgtgcttcacaacttgttggccgaaagcgagtgcttttagctgcgcaggtgtcggttgggttacggtaactacggtaaaatcagctggcgtttcgaaggccgcgtcgacctcctgacgtagtaagcccccaccgactgaaatcgtttcaaacttatcggccgtgtgcgtttgctcaaagtcaaccgtcatcaagcgcagattcttcttcttggccaaaatagcaaaggcatcgtcatcaaaactcggggcaataataatttccaagaagagtgcgtgcatcttctcagccgttgcgagatcgactggtcgatttaaggcaatgattcccccaaagattgaaatcgaatcggcttcataggctttgtcccaagcagcctcaatcgtcgtacccaagccaaccccacacggattcatgtgcttcattgcaactacggccggctgttgatattcactgaccatccgcaaggcagcatccgcatccttgatgttattgtaagaaagctctttcccatgaatttgcttggcacccgtaatcgagaagtgcgtcggtaaagcattttcgtaaaaggcagccttttgatggctattttcaccataacgcagggcctgcttcttatcataagtaagggtcaacttttctggaaattcttcagtcgttaaatattgggcaatcaaggcatcataggccgcagtatgttgaaaaactttggccgctaatcgctgacggagtgccggtgtgaccgcgtccgtctgcaaatcagccagaatctgctcataatcagcaggatcaacaattggcagtaccgcggcaaagttcttagctgcggaacgcagcatcgacggaccaccaatatcgatttgttcaatagcttcagcttgtgtgacgtctggttgttgaatggtcgctttgaatgggtacaggttaaccacgaccatgtcaatcggttgaataccagctgcttttagttgcgccatgtgcgctggcaggtcacgtcgtgctaatagtccggcgtgaaccttaggatggagcgttttgacccgaccgtcaagcatttcaggaaaaccggtcacttcttcgattccgatgactggaatatcagctgcttccagtgcctttttggtcccacccgttgaaatcaattcatagtcaagggcaacgaggcccttcgcaaaatcagttaatccctgtttatcagaaacacttaacaacgcacgttttgtcatcttaaattgctccttcattaatgagtgtctgtaatacatctggataaaattggtgttcacaatcatgaatccgggtcgccaggctggctagcgtatcgtctggtgcaaccggaacgacccgctgggcaataatttgcccggtatcgattccggcatcgatatagtgaatggtaacgcccgtctcagtcacaccagcggcaaaagcatcctcgatgccgtgacgaccaggaaactttggtaacaatgctgggtgaatattgatgattttatgagcatacgcattcaagagggtcggaccaataatgcgcatgtacccggccaataataccagttcaatttgccgtgcttgcaaggccgtcaaaatgattgcttccgcggccgctttattcgcataatcatgaaaatcaacaattaatatcggtacgttagctgcccgggccttgtcaattaccggcgctgtcggttgatcacacacaagtaacccaatcactaccggtaattgtcgttcaataatcgcttggtggagtgcaacaaagttggtgccattacccgaagcaaatactgcaattttattaggcatgctcagcctcctcaaaaacaacgggtgtcgtaccagtttggactgttccaactcgataataggactgagcgttggccgtcaaattagccgtcacagctgccacttggtcggagtgaacgatcagaaccattcccaagcccaagttaaaggtcgaccgaagatccgtagcagtcagcccaccgagttcggccaataacgtcataatcggcggtgccggccattgacccaattcaaggtgcgcactcaagcccgccggtaacgctctggcgacgttctcaatcaagccgcccccggtaatgtgggcgatactcgtcactaatttctgctgtaataatggttgaactgcatcaacgtaaatggtcgttggtcgtaaaagttccgtttgtaaatcatgaccaagttcgtcaaaaaccgtggtcaattggtagtcgtgttgtttgaataaaatatcacgaactagactaaacccattcgagtggaggccattagacggcaacccaatcaagacgtccccagcccgaacatttgctggtgataacaggtccgcgcggttcgcaattccgaccgcaaaaccagcgaggtcgtaatggtcctgaccatacatattgggcatctccgcagtctcgccaccaatcaacgctgtatgggcctgctgacagcccgtgacgacgccagtcaaaatggctttgacccgcttctgatccgtatgtccaagacctaagtaatctaaaaagaactggggggtcgcgccttgtgccaaaatatcattcacacacattgcgaccaagtcaattccaatcgtggtatgttgatcagcagcgattgcgactaagagcttagtccccacaccatccgtccccgctactaacacgggatcgttggcagttgcatccgaactaagtggaaacgcccccccaaacgcgcctaattgctgattgccactcatttgtttgaccgtctttaagacgtcgtaaccagcgttgatatcaacgccagcccgcttatacgcatcgctcacttgatcaccccttcatgattggcttgtaattgcgcaatttccgcatcatactcggcttggtaatcatacagggccgttggataatccccattaaaataggccatgcatagtccaccatacggttcggtggtcgacaagccaactgcatcaacgacgccctgttcactgagaaaaccaagtgagtccgcaccaaacgtctgacacatctcccgaatcgtttgctgagccgcaatcaattcattagtcgattgaatatcgataccgtaaaaacatggatagcgtaatggtggcgatgcaattcgtaaatgaactgactttgcacccgcatctttcaataatttgacgatccgccgactggtggtaccacgtacaatcgaatcatcgattaagacgactcgtttaccagcgacaacacctttgaccgctgaaagcttcatccgaaccccctgttctcgcaatgcttgggtcggctgaataaaggtccgtgacgaatattgatttttaattaatcccatctcgtaaggcaggccactcgcttccgcatagccggtcgccgctgataaagatgaattgggtaccccgacaacaatgtcggcgtccacgggctgttcaacagcgagctgagcacccattcgtttacgtgcagaatggacgttgacgccgtgaatatcagaatctggacgtgcaaagtagataaactccattgaacaaatcgccaactgtgtatcagtcgtataatggtcgatcgtcaaaccatgatcatcgatcgttaacaattctcccggctgaacatcttgaacaaacgtcgcaccaatcgtatcaagcgcgcaagtttcactacaaacgacgtacccgcccgtgggtaactgaccgacgactaatggtcgtaacccgttaggatccaaagcggcaatcaaacaatcattcgttagtagtaagtaagcaaagcctccgtggacttgacgtaaagcatccttaacctgttccgttaacgttgctgcggggctgcgtcgaatcagatgcattaaaatctcactatcagaactagcatgaaaaatggcaccatgctgttccaaccgtcgccgcagtgtcaccgcgttcgtcaaattgccgttatgtgcgagtgcaaactgtgagtcgctaaaattaaaactcaagggttgaatgttttccaatccatgattaccagccgtggcataacgtacatggccgactgcagcttgacccgtcaaacgtgccaaccgccgtgggtcccgaaagacatcagccaacaaccctagtccgcgttccgtctgcagtttgccgtgatcattcgccgtgataccggctccttcttgcccccggtgttgtaacgcatggagcccaaagtacgttaattgggcggcgtccggcgagccccaaaccccaaagacgccacattcttcattcagacttcttacttcagtaggcatggtaaggccccttcccacaactgtttggcgaaactaaccttaatatcaaacgcctgatcagcagtttgaacgtgtagccgatccgttgcagttgttcgtcctaaataggtcacatatggttccattaaactttcaaacgcggcttgctgtgctggtgtcaccgagataacaaatcgtgactgcgtttccgcaaagaagttggcagcgggcaagtcactggccagttccaccccgatattttgtggaaaacatgattcggcaatcgtcgtaatcaagccaccttcagaaacgtcgtgggcactagcaactagtcctttttgaatcgcagttaacaatagacgctgattacgattttcagtcacaaggtcaaaatcaaacagctcgccactgattgttcccgtcaacatcttttgcagctcactaccattgaaatcggcttctgtggtacctaacacgtagactgcatcgccagcgtgtttaaaatcgctagtcgtaatatctttctgatgcttaattaacccgaccatcccaatcattggggtgggatagatggcttccccgttcgattcattgttcaacgagacattgccagaaatcacgggcgtattgaataattggcaggcacgagcgatgcccatcgccgattcgtccaaatcgtaaaattgttcaggtttctctggattaccatagttcaagcaatcagtgatgcctaaaggttgcccaccggaagcgacaatgtttcgagcagcttccgcaacggcgatttctccaccgacacgggggtttaagtataagtatcgcccgttaacatcggtggtgaccgccaacgccttatccgtatgtcgaatccgtatgacccccgcatcggaacccggcttgacgaccgtattcgtttggacctgcgagtcatacgttccatataacgacgctttggaagcaatcgttggctgttggagcatcttcttcaatgtgccagttgcatcaactagtcgtggcataaattgatgatggctctgatggttcaagcgcgttggtcgtttcttttcgcgttcatagaccggcgctttggtcgcaagtgcatcgacgggaacatctgcaactaacttaccatgatggaataattgatactggtggccggctgtcactttaccaattgtgacagcatcaagaccgtacttttcaaagacttgataaatttctgcttcggcaccagctttgacacatagtaacatccgctcctgtgattcagagagcatcagttcaaacggcgtcatgccagtttcacgttgtggtaccaagtcaagattcagtgacaacccactgcctgctttggacgccatttcggctgaggaggaaactaggcccgccgcgcccatatcttgaatcccgattaaaacatcacgatgatcatgaataacctcgagacacgcctccatcaataatttttccataaagggatcaccaacttgaaccgcggaacgctgggtttcattggcgtcattaaattcagcagaggcgaaggacgcaccgttaatgccgtcacgccccgtttttgcgccgacataaataacggcgttgccaattcctgttgcttggcccttctgaatatcagcttgatccaagattccaacacacatggcgttcaccaacgggttcttctgataactcgcatcaaataccgtatcaccaccgattgtcggaattccaatacagttgccataaccgccaatgccggcgactacttgcgaaatcaagtatttcgtatgagcatcagtcggttccccaaagcgaagactgtccagcagcgcaatcggccgggcccccatcgaaaagatgtcccgaatgataccacccacacccgttgccgcaccctcataaggttcaactgcagacggatgattatgactttcagctttaaagaccacggcctgaccatcaccgatgtcgataataccggcgccttcaccaggcccttcaagtacctgttcaccctgcgtccaaaattttttcaagactggttttgaattcttgtaggagcaatgttcgctccacatgccggaaaacaacccggtttcagtctcgttaggtaagcgttgaaggaccttatccgttaataattgatactcagcatcggttaagccccaatcccgatagaccttagaatcgcgaacatctgtaggtgataatggttgctttttaagcatgggtgacctcctcttgactcgcaatgaccgattgaaaaattccgagaccgtccgtggaacctaagatcatctccacggcccgttccggatggggcatcatcccaagcacatttcccgcttcatttgtaatgccagcaatattagccgtgctgccatttggattctcgacgtattcgaagatgatttgatgattagcacgtaattgcgccaaggtgccctcatcacaataataattgccttcgccgtgggcaatcggtaaactaatttgatctgtcgatccgtatgcggtggtaaaaatcgtctcatgattggcaattcgtaatgggctgtcctgacaaataaacttcgctgagcgattggcctgcaatgcaccaggtaataatccggcttcggtcaagacttgaaagccattgcagattccgatgactggtttaccagcgttagcaaatgcaataacggccggcatgatgggcgcaaagcgggcaatcgcaccactccgtaaataatcaccgtacgaaaagccaccaggtaacaccaccgcgtcataacctgctaatgaggtcgctgtcgccggaatcaaatcagccgtaacgtgtaaaatatcgcgcaaggcattcaccatgtcatgatcacaattagaaccaggaaagactggtacggcaaatttcatcattacaaagcctccatctcagtaatttcgtaacgataagtttccatattaacgttggctaacaagcgatcacacatctcgtcgatttcagcggcaactggccgatcatccgcgtgaattttcacctcaaaatacttacctaattcaacggcatcgacattcgtatatccaagtcggtgtaaggcatcatgaatcgcctcacccttggggtctagaattgattgcttataagtcacatagattttaactaagtacatgttaggcctcctcaacggttgctagccgcgtcaatacttcctgataaacactagtcaagtcgcctagatccttgcggaagacatccttatcaagcgatgcaccggtctttaggtcgactaaccgacaactatctggtgagatttcatcagccagcaagactttaccggtggtcgtcaacccaaattcgattttaaaatcaacgagctgtacccccatcgccgcaaaaattgccatcaaacgctggttaacctgtaaggcctgccgtttaatttccgccacgattgccggtgttgcaacatttagcgcgtggatttgtgaatcattgataaatggatcatccagctgatcactcttatagaaaaattccagtactggttctgcaaatttggttaagtgtggcacggcaaatttacgctcaaaactacccgaagccgcattccgaacaactgtctccaagggaatcatggtcacgcgacggacaagttgcacatagtctgaaggttgctcaataaaatggttggcaatgccgtgattggctaagtctttgaaaatcaaactcgcgatgcgattattcaatcggcctttctggtcaatgggaaccttccgcttaccatttagcgctgttgcttgatctaagtattcgacccatagaatttcaggatcattagtggcatacatcgctttcgctttacccgtgtaaagcaaagcttgtttctcaatcgctgccgtcattattattgttcccctttcaaatttgccaccgacgctaatgctgcgtcaatatcgtgatttaatacggtgacatgacccatcttgcgctggggcttaatggccgccttaccgtagtcgtgaaaatgccattctgggtgttcaaccaactgttgacgtgccactgttaagtcatcacctagcagattacgcatcactgccggactggtctgcgtaatggccggaatcggtaagccacagatacttcgaatatgggcctcaaactgcgagatgttgcaggcctcaatcgtatagtgaccagaattatgtgggcgtggtgccagttcattgactaataaagtatcatccggtaaaacaaagaattcgattcctagcacgccgcgtagtttcagggattcagcaatcgaaaccgcaattttgcgggccgcactatgaacactgggctgaacattagctggggcaatcgttgtgtgtaagatatgatgttgatgctgattttcaactaacggaaaagtcgtaacaacaccagcagcactacgcgtcaccatcatggaaacttctgttcgaaatttctgccgcgcctctagaatgcacggctgtgtcaataaggcactagcggcttttgtcaccactgctgtgtctagatccgtttgtccgtgaccatcgtagccacctgccgccgttttgagaattgccggcgtaccaacacggttgagggcgtaatttaatgactgtaaatccgccaccggtgcgaaagatgtgactgggatgccatgatcatgaagaaattgcttctcattaagacgatctccagtaatatgcaggagtgcagtgccctgcggtaactttgcataggcttgcgcagcaatcaaagcattctcatcaacgttttcaaactcgtaggtcaagacatcactacggcgcgctagatcaagtaaagccgcctgatcatcataagccgcaacaatctgaaaatctgcgacctgggctgccggtgctttgggtgtcgggtcaaggacacctacccgatagcccatcgccttcgcgctaagcgtcatcatctgaccgagttgaccgccaccaacgattccgatcgttgcgggtggtaagagtgcttccttaaaattggcgttcactttgttcagcctcctgacgttgacgagcacgaaattctccaattgcatgttgtacttgtggttcccgtaaaccgataatttgggcggccattagcgcaccattcttagcccccgcatcaccaatcgccatcgtcgccacgggtacgccagctggcatctgtacgattgacaataacgaatcaactccgttcaacgtatgggtcttaatgggcaccccaattaccgggagtagtgtattggcagctagcatcccgggtaaatgggcagcgccccccgcacccgcaataataacttgaattccccgtgacgctgcttcttcaccataggattgtaatgtctggggcattcggtgggccgaaataacgtgacgctcataagagactcccagtgccgttaactgttctgccgctaattgcatggttggccaatcagaaattgaccccataatcaaaccaactttcgccatcatgatccctctttccctgttttcaccattagtttagcaatcaggcgggacgctgtcaacgaatttcttaactttatctattaattaacgttttaatgttcgtgttaatgaaattgataattagattaatgctacctcaacatgtacgaattacctcactgtttgcaggtttccggtgtctggaaaaagttatcaactgatttcaagcgactattttgataatattattaatattgaaatttccgaacaatccgtcatcatctaaatttcaccataacaaacttactgctaccattatcaacaactatccgttgaaacgggccattaacttttgtcggtgcgcaccaacaattaacagcaatgactgggaatcggcgtaggacgagcaactaagcatgtttatgctaactcagattatttatagcggggctaaactgactgccgctgaacttaaaaacaatcaacaacttaatttgcgaacgctttcctaaaggatcggattgaagtgaccaaaataacgcaaaaaaagtctcaaggaagtgattcctcgagactttttaaggtactaattattttgctgaagcgccggaaacactatcgacatcaggtgcttcaggcttggttggtgcttctggtgcggcttccgtatcggctgaagcgccagagacatcatccaccgctggggcagcatcaggcttcgtttccttcgccttcgatgaagctcctgaaacggcgtccgtcttagcatctggatcaggtgctaacatctggcccgtctgcttcaggtaatacttcacgattggtaagaggtcgagcacaaactcgttgatacctttgtactcacccttatcgtcatgcaaagcttgataatagtgcatcacatacttattagggataccaggtaccggtaacttgaagagatcagtctcaccggttcgtagcatgtgtaccgctcgcttaacaccaggtacggcccgctttggatgacagtcagctagtggattaccggcttgagcaggtgtccgtgaagctaacatcttgtcgccatccatttgatggttatagtataaaaattggttgttggcatcggcatacgtcaattccattggcatcgagttgaggaaccaatttaattggttgacggtcagcacaccccgatcgagcttaacgtagtcgtcaccctcagccgcatgggtcttggcagccgcttgttcgacccaatcagccgcatgcatgttgacgcccttgattgtcgtttcaacttcgcccttagcctcaaggtcttcattcttccaatcatcagcgtgtgcttccgcatccatcgcgttgaccatcttgacaaacttcagaaacttgcctaacgtttcttgtaagaacgagacagtccgagcatccttcagattgttttggtcatcgaaagcctgcttaacttcgccgagcaaaaattcattaccaggcatgaccacagcatcaacacccggtgactctaaaatctggcgtagattcaactgtgcccgcgacgaaccttgatcatagtaagaagcgccaacgatcaatacgggtttccctgacatcgggtgaattttaaacgacaaccattcgatcacgcttttaagtgcagcagtaattgtatgattatgttcaggtgtcgcaataatgaccccgtccgcctgcatgatctttcgtttcaaatattgaacagcttcaccttctgtttgatcatcactctgattaaacattggtacatcttgaatatccaaaatttcaatatcaaccatgtcactaaaatgattagcaataaactttaacagtaaccgattataagacttatcttcaattgaacccgcaattccaactaatttcatcgtcgtcgccctctctataatttttcccaatccatttcacgaacttcttcatacgtcgtcgcgttggcattctttaattttttcgtgatttcgacaaagacttggaaatccttgaacaacccatcgagcttcgtcgctttctgttggtccgttaaattcccctggtcatcaaaggcttgcaatgaatgaccaagcataaattctgaacttggcatgatccgcgcccgtaattctggtgaatccaaaacttgccgcagatgtgcttgagcccgtgatgtgccgagtgccccgtatgaggccccaataatcatgacgggtttgtccacgaagggctggatatggaatgataaccattcgagagcattcagtaatgccgcgggagccgaatgatcatactctggtgtactaataatcacaccatcagcttgttcgatcttatccgccattgcttgcgcctgtgccggaatttcatgattttcgggcttattgaagattggtagacccttgatttccattaattcaatctctgcttgatccgcatagtgggactgcatatattgcaacaacttacggttggtcgactcatctgaattagttccaaccatcgcgataaatttgtgcattgagaacaactccttctatgatcaaatagtcaaatattatataatttcttagtcaataactatattgtagtggatttcactaaagaaagcaaaacaattttaagcgctttcagttttgctatgcaaacaactgaactcactgatattaggcttatccgtgcaatcaagtaaattcagtatccgcgcaacgttgccgcaattatatctgcttaacaaattttttcacaaagctacgacgctacgatcaaatcaatcaaatccgccggggaaattcgaccaaagtaatgggttaagtccaacggtgctagcgccgtcataatcgcctgccgttcatatttcacaccagtcaaccgtgcaacgacgggagcaatcggttctgcaccgaagaaatcgccataaatcgtaactgcttcgatgcgccctgccaccacgtttaactgaaactcgacggtcccagcatcaaaatgccggcgctgcttaactgtaaacgctggtgactgaccgtaaatccaatcccagttggtaaaatattgttggttcagtgctgctacccctgccagtgccgtttcatctaactgatacgtcttagcttgactcaaatcagccacgcccaggatttcacgggccaacgtatcgcgaaattcctcaatcgtcaagtgctgataagccggcgccatgtacggtttcaatttcgtgactcgacttcggaccgacttgatacccttagaggccaacttatcggtcggcaccgtaagagctttcgcaatttgcgtctggtcgacatcatacatcagcgttccatgggagaacatccggccattctcaacgtgcatggcatttcctgagaacttcttgccatcaatcaataaatcattgcggccactcatcgtcgcaccagtggcccccatcgcgtgtaaagcctttagaactggtgctgtgaaccgcttaaagttaccaaaaccgtccccgtcgtccttagtaataaaactaaaactgacatttccaaggtcatcataaaccgctccaccaccagaagttcgccgcgtcaatgtaatgtggtgtgcgtcaacatagtcctggttaatctctgccttgacattttggtaacggccaacaatgatgcagggggcgttaatgtaaaagtatagaatcggttccgtcaaatcggcatgttccatcaagtaagtctcaatggcaagattcgtgcgaatatcatggctggagcttgcaagatagcgcatcgtcacacttcctattctaaataaatccgttgcaaatcattgatttcattgttagttaatttaagctcagtgtgtaaatagtggtttaaattacccgattgtcgtttaatttcggtcatagcggcgtccaaataagccgcatcaactgaccagagggcccgaatactttcgaccgttgcatctgatgcgccctgagcacgtgcttcggccatcgcaccattgatccggccaatcgaagcctgattagttaagagataatcctgcttgatcgtttcaaaatcgactccgagtgcggttaacaggtataccgcccccattccggtccgatcttttcccgcagtgcagtgaaatagtaacgtcgaatcgggttgatcatttgcaagtagattatcaaagaaccggcgatactcgtccttggcatgttgctcgtcggccaccatctgatagacctttagcatgtgcttgaatccactatctggatgcttctccaagttagccgtcatcttgtcagtaccgtcagaattccgcgtttcgtccacattgaacactggtgcgtacacgtacttagcattggcaggaattcgatctggcgcatctaagacttcttgtggtgaacgaaagtcaatatcgtagcggacgccataatcatccagcaaagcttggccggctggcgttaattgatcaagtccaccagtccgaatgaccttatgccacttgatttttcgaccgtctttagtcgagtaaccaccgagttcacggaaattaatgccacctggtacagttaatacacgttgatttgtcatttttgaaaccacctatctgttaacttttcattttctattctaacattatcggtcagtttaacggtgccccaatcaccgaatcagtcgctttatttccaagataattcgttagcaccatcgacaccaaccgacatcaacgcgtgctataatgtaagttacatagccagcgacggcccgtcgaatccagaacacgtttgctgacaaacagcatcacaaccttggaccgattagccataaatttccatactggcactaaataaaaaatattcactgaataatataacggaggatctttcgatgacatttgattatgcacaccaaactgattggcccatgactagtggtcaacatcagtcaccaatcgatattcaaacacaacacgttcagtcttcacagctatccgccatcagctggcgaggcttgtaccaagccaaaacgattacgggcgaagcgacaactttgaaggctagtggaattggtgccgcttatttgaacgaccgcgactttgcctttcaacagattcactttcatacgccggcagaacacttaatcgatgggcaagccgcaccaatcgaatggcatctcgttcatcaaagtgctaccggccagctcgccgtcgtcgccgtttttggacggattggcaagcctaattctagtttacaaggcttacttgaccagttcacagcccaaacgagccatgaactgacaacaccggtcaacttaactgagctcctcccagataccgggactgtctatcactacttgggctcattgacgacgccgccactaagtgaaaccgttgaatggtatgtctgtgccgatactgtcatgattggtgaacaacaattagctgcttatcagcaattatttgccgctaataaccgcaagattcaaccgttaaacgatcggccaatcattgccgaacgtttctaaataattttaatggggtgagctgatgcctaagaaagtaatctggggcttgattgcaagtggcctatttcttttattgatcgtcggtctcggactgacaacacaaatccatcaagataaagtcagtcacgtgattactgcgcaaaaacggccattgatcatgattggaggtagtagcagcacgcggactgactttgatgacatcgtccgttcacttaatgagcaacagcaccatccgctcatcaccctgactgttaaggcgaaccaaaaattggcgtttaaagaaaaacgcgtcgagaacaccaaccttaacgatgccctcatcgtgatctttttcgaagatagcacggactcaacagagaacattatgacccaaacgaacggcttagccaaagctattcgttatttgcaacgtcaccaacatctcaccacggccaacgcactcggttattcaaatggtggcctgatctggagtcgctatctagcaggtttgagctcgtccaaaccattagcagtccacgatttgatgttgattggcaccccattcttgggtactgatgctgcacatcctgataaaacgctctatacaccacttcttgatcacaagaaccaattcaagaaattgcatgcggtcatcaacattgccggtgacactggcgagggtaacgacgatatcgtaccgctcagcagtgtgaacgctggtggcaacttatttatgaacaatgttacccgctataccgccatgactgttaaccaaaaatcaattagtcacggtgacctgcttcacgaagcatatgttgcccggctcattcgtcaaaatctgatcaatcaatagtatctttagctttagctgataaaaaactgagccacccttcataatgatgaagtgatggctcagtttttttatgattgatcgtccgctatgactactggcgatcaaactatccaacaatttagtgtcacgagtagcccacacacgggttgcacagggctcaaaggggcgccacgtcgattatgaattggcagtcgctacaaatcgagctagctcatcggtcgacataccggcactgacacccaccagtaacttaatccgggctttttgtccattcaatccctgacaaaaaatcacacccatttgtttcaattgaacaccgccaccttcataagcatagacatcctgagcgataccgttgaagcaccgggaaaccagtacaaccggaatctgcatgtctaataatttttgcacagctggtaacgtcgccggtggcaaattccccgctcccaacgcttcaatgactacgccatgagtcgtgggttgtgcaacggcgtcaaatagttctggtcccatcccggcatatgctttgatcagaaaaacattatccgtgaccgtttgaatcgggcaaaccgttgaccgtagtaatgattcaaaaaagacaatgcctttattagcgactaacccaatcgggccaaaagtcggtgttctaaaagtggccacgttggtcgtatgcgtcttagtgacgtagcgggccgagtggatttcatcattcataaccactaaaacacctttttcggccgcatccggtgtactagccgtttgaatcgccgtttcgagattatgcagaccatccgacccaatctcattggcggaccgcattgcgccggtaatcacaacggggagctcattcggtaaagtaagatctagaaaatacgccgtttcttctagcgtatccgtaccgtgagtcacaaccaccccatcgaccccttcgtgtgcggccttatcgatccgttgctttaactgcaacatccgtgccggggtgatgtgcggcgacggcacgttaaagacgtcctcagtctctaactcaatatccgtgccaaatgaactctgataattgtctaaaggattttcatctccgggggtcacattgccggattcatcggccgacatcgcaatggtgccaccagtgtgtaataccaaaatcttcttcaagaatactcctcctcatcttttcacgtgcctacgcacatctaacagtaaaattattttaggcttgccatcgcctaattgcaatccaccctcactggttcttcatgacaacttccttagattctcatacaagtgatatcaactaaaaaaactagcaaccattcaaacaatttacaaaacctagcaaccagatcagtacgttttattagcctacatagtgctagtcactcggttagttcacttatcaactagttcgttaatcggttcgtcggttagttaccccttcaggacgaagtcactaacctcagtgcaccttattactcaatttcagtctcggggctaaccgattggccactcgctagacgttgataaatcagcgtttgacgtcccaatgactatcaagcgagaaaataatgattgacactcgcgttagttgcctttatagttagttacataagtaattaaccaaataacaaaccaactaacttaagagaggtatttaaaatgacaaccacaccaatcatgaccgtcagcgacctgcacaaaacgtatggtaaggcgggcagcaaacaatacgaagcgttaaaaggcattaatttcaatgtgcaaccaggggaatttgtcggaatcatgggcgcatctggttcagggaaaaccaccttgctcaatatgctggccacactggaccaaccaactagcggtgaagtaacgattcatcaacaaccgattacacatctgaaaggcaatcaacttgctgatttccgggccaaagagattgggtttatcttccaagatttcaacttattagaaactatgactgcttacgagaatatcgccctaccattgtcgctgcaaaatacgccagtcaaaaagatcaagccagctgtcgaaaaagtcgcacaccaattgggaattgaagaattcctatcaaactatcctaatgaattatctggtggtcaaaagcaacgtgtggcagccgcacgagccttaatcaatgaccccgctattctatttggtgatgaaccaactggtgcccttgattctaagtcagcgcgtgaattactcgacctgttcaccaaaatcaaccaagaacgggctgtctctatcttgctggtgacccatgacccattttcagctagcttctgtcaacgaatcttattcatcaaagatggccggattgggcaagaacttaaacgtggggatttaagccgcagtgatttttatcaacaagtcctcgacaacctagggacgtttgaacagtaagccgaaacagtaaaaggagtcctttaaactatgttaactaaacttgccatgaccggcttcaaacaccgttggcgcgactacctcgttctcttttcaggactgatcatgtctagcgcaatcttctatatgtttgaagcactggccactaaccaagatttcttaaaacaaaatacgagtattagtatggtcggcctcatcttccaatttggttccgtactactcacaatcatcacattagtctacattggctatgctaactcattcttattaagtatgcgtaagcgagactacgggctcttcatgctcgttggtgcacgcaaaagtaagattggtcaattaatttggctggaaacactacttgtcggtatcactgcaaccattgtcggcattcttgtgggaacagccttaactgtcggtgtaagccagattctgattaacagtctaggcctgacgcttcaccattttgcagcctggtacacgccagctgccattgcgacactgttactctacgttggattgttcttaattgccggtttattcaacctgctatccctgaccaagacaccagccttgaaattactacacagtaatgatcaacctaaccggccacaactaaaaccagcccgtcaactcatcgaaattgtcgtcggtgtcatttcaattgcaattggttactggtcaatggctaacctgaaaattttgcaactgatgggaattggaattgcgctcgtcacaattgttcttggaacttatctgctgtttaacgctatttttgtctggttaatggtcgcactcaaacgattctcatttgcccaacgtggtttgaatggcttcaccttatcacagctaagctttagaattcgtaattacactaagatgctgtcaattgtcgcaatgctattcgcactagctctcggcgcaattacagttggaatgggctttcacagtcaaattccatcaatggctaatattaataacgcttatgatatgggactggtcaacgctagtaccgctgaaaaagcacaaattgcagcgatgaagcccaagacaacggcgacctatcatttcaaagcaaccaagaaagtcgtttatttccaagctgctgaattcaatcggcaaccattcacgactattcatactcgcaataagaatcaactgacttttaataccgttcataataatgcggctaaattacaaaaatcagaagataattatcaactgatgcagcttcagagtggtgtcatggcaaccgcaacacccgtatttttatcaaaaacggcgtacgcgaaacttgcccagcctgaacagcgactaactgtgtttactaccaacaacgttatcgaacatcgcgttgcattgaacaaactggccaaacatcactttcacactaccagccctgaacaatttggaggtcgctatgcgatgtatctaatggttaacggcatgtactccgggctggaatttatgggtatgttcctcggaatcgcctttcttgcaatgctagctagttgcctgatgttcaagattctgtctggtgccgatgctgatcaacaccgttacaagatgctcgataaagttggaaccactagacgccagctcaacggtgccattaacaaagaaattgctgtgctctttattcttcctggaatcgttggtattgtacacgtcttgtttgggttacaaatgttcaaaatcataatggttacctcaccatataccggaatttggttaccattcttgatttttgccggtctctacctactttactatctcattacgatcaccatctatcggcgaatcgttttacaataacctttcggaggagggaaaaatcatggtatactttggattagtcgctttattaatcgttattacaccattacaccgttacgtgctcgcaagtcgtcgtcaattctggttaggggcgctcatgccgcttctgtggctgagcgttaacttcggtttagccacccagattatctttgaacatcaagacattctactggccgtactgggcaccctcctcctactctctagttggattgctgcccggatcgatcgtaccgaacgacaactgcaccagccgcaacaaaaggccacaacgaaatagggcaatcactgcaatgaggtgaataaaatgcagttcaactttaatagcacggaaccaatctacttgcaggttgccgaccaaattgaagaagctatctttacggaaaccttcgctgaaggtgaacaaattccttcgacaaccgagatttctaaagaatttcatattaatcctgcgaccgtgcttaagggcatgaatattctagttgatgcccaactgattgaaaaacggcgtggggtcgggatgtttgtcatcgccggtgcacaacaacgaatcgttgaaaagcgccgggatcagttctacaccgactacgttaaaaaactagtcgctgaagcacaaaagctccacattacgcaagatgaattagctaaattaattgaacgggggttttccgaatcatgagtattcaagttcaggctgtccagcaggcctttcgcggtcaaaccgtcctggataatcttaacctaacgatcaagccaaacacgatttacggtttgctaggccgcaatggtgctggtaaaagtaccttgctgaacattatcagcaatcgtatctttgctgacagcggaacggtcaccatggacaacgaatccatgtgtgataacgaccgcacgttaggaaaggtttacttgatgagtgaagttaacctctattctgagcgttcccgggtcaaacaactgtttaaaaccaccgcactactctatggtgattttaatgacacttatgctaaaaaactagcacaaacctttggcctcgatttaaacgcgcgatttggcaagttatcgacgggttaccgaacaatttttaaactgattattgcgttatgtgtgccggctgaatacatctttttagatgaaccagtcctcggcctggatgctaatcaccgcgaaattttctatcaagaactgattgaaacctatagtgaccatccccgcacattcgtgatttcgactcatctcattgaagaaattacgaacttgattgaacatgtctttgtgctggaccatcatcatattattgttgatggtgatgtcaccgacatcctaggacaatcttacgcggtaactggtccacaaactgatgtcagcacttatacggatggtttaaatattatcggcaaggatcatcttggcggaattacggcccactacgtttacgggccattagataacgaccgaccaattcctgatacggtcacggtcgagcatctggacctacaaaaactatttgttaacctgactaataccaaggaggaggccgccgctcatgtcaattaaggttcgcaacaccacccgttatttattaacggaacaattgaaaatgacggggtggtcggtactcgctttattcgtcgtattcggaatactaccgctactatttgcagttattacgggtaatattcggcagtattctccacttggtaattttgctagcctaagcctcgggccactcttcttcatgcttatctttattgtggggtcactcacttacgacaactttaagctcttaatccaaaatgggatttcccgacaaacctactttcaagctcgagtattcgcattactcatgcttagtggtttgcttgtcatcatcaatgccatttattactacggtattcatgctccgtatttacactggagcaccaacaccgcgttgatgagaacgggctattcgctgtatagccatgcgctgggaaatcaggtctggctaaacattttagctagcttatgctttaactggattttctacattggcgttggccttaccggcatcgcttgtgggaccttactcgcgttatttggtaaatgggccaaaacgattttaatcattggcactcccatcattggcatgcttattatttggataatggtcatcattatgactcgcaatcaatcgaattataattacacgggacttgaaaacttcttgaaatttattattggttatcccagccacggtgaagcgacaactggttactttaacccaaccatgccattcatcacaatgctggtaggttgcggtatcatcggtggtctcgcttatctgttcaaccgtaagttaagaatcagaaattaagctgataatctaaaaaatgaagcaggtcgtgaagttattgacttcacgacctgcttcattttttaatggttaatacaaacgtcacaccattcgagaagtggttttcccactaacgctacttttcaacctgcgtattttgcaaatccgtcttaaccacgattacatcagtcaacgcattacgctgcacatacgttgtaaccgagccttccagcacgcgttcaacggcatttaacccggttgcccccatcatgatcaagtcattatgatgatccttgacgaagtcctgtgaaataattggtttcggacttcccattcgaatgtggaaggcaatgtccgtaaagccatcctttttgacttgatcaaccgtttcttttaaataagcttcagaatcctgaaccaattgatacgtaatatcaccatccgccaaaccagctaaattatacccaaactgaccgggatcaatgactgctaacacgtcgatatgtgcctcattacgtttagcgactgcaactgctttatcaagcgcaatctcagcttgttgtgagccatcgaggggaactaaaatattcgaatattcttgtaccattgacgtcacgccctttccatctgttaattctattttaccatttatcagcgttggttgcgttatcatttatataaactaactaccagttatgcacagcagctcgccggctagcagtgtcgggtttacataatatttacaacaacgacatctgatatttacagttaccccttacaattggagttaatccacttgggggtgaatagtatgctttctttaggtattcgaccaggcctaatcgccagccatacaattgtaatcaacgatgccctttcatatcaaatccggttaagcaaattgcgtctcggacccgatgtctatcggctagacatccgtgcaaccactacactgggccgcttgaccgtgtcccacgcacattaccataactttgccacggcccagcaagcctttaatcatcagcgccaccaacttgaatcgcactaaaaatatccaacacgcagccatttaattatgataggatggtacctagtaataatcagctaaagtgagggtattcatctgtgggacaacttatcaaacaactctggcaacgctatcaaagcgtcctttcctatttaatctttgggggcttaaccaccctaattaatattattgtttttggaattttcaaccaattctggccctactggatagccaatacgattgcctggctcatctcagtgctattcgcctatatcacgaataaaatttgggtatttgactcacaaacacctactttccgtgctgttttaattgaaatgacatcattcttcggattccgcctactcagttactttattgaccaggggattatgattgtcggtatttcggttctgcacggaaacgaccttatcgtcaaattaattgatcaaattattgtggtattactcaattggttcttcagtaaactatttattttcaaggaccgtggtcattaaagcgaaccaacttaaacatcaaaacaagcgtcgtaggaatgtccgaaaattcctgcgacgcttattttattcataataattaccgccccatctttttttctgatacttaacttagctactattttagcaaccatattttcacccaaactggcgttgcaccgtatgtaacgtcgctaactttgtgaccacatcatcaatattgaccccatcccaattataaaaaatatattggcgaccacagcgcatcttaatcaccaaatgacgtgctgatgaagcataaccattgcgaacttcggcctgatccgtcgtcaatgcatagtattgaatgtcatccgtatttaaagctaactctccaattcgtatcatgacttgttgactgacctcagtcggcggtcgaactgacaaacaagtcccatcatggtgctgataccgtaactctaccgcaactaaaccggccgcggttagctgcggtctaaaataaaactccgcgccaatatgcaacgcacttgacggccaaactgcggttagccgaaatttaaaatgccggccatgaaaatcagtcaggatgccttggtcgtaatctggttgcattaccgtaatatgcccaatcatgacgattcactcccttcacttagttattgataatgtatcacgcttcacaagcatagttgtgtttaaaacccataatcagtcgtttttaccattttttattaaaatagtaattaaattatccttactcatactaatatttgagttaaccaactttattgatcggaggtcccgttttgatgacatttacaaatcaagaaactgactatcttatgaacctactaaccaaccagttaatggccctactaagccgcgtcacgcgctggcagacgcacagtctgagtcaacaccaatataaccaacaagtacacgaaacgctccaacccgaactgaacatgctcacgcaaatcactgctaaactccagggacaagcccgtgaccaaactcagctaggggccattcaaactggtttgaagaaacttcaagttgccaccacctatcagctaactgccgaccaacttgcacacgctaatgaacgccggctgaatcgccgataccgcgattaacttttacaacatcagcatatttaccaggagattcaaaactatttcgcaatccttaacagaaaattcaaatttcaatcacgagttagctactttttctcggtacaatggttttatcaactcatacaaccacttgactgaaggagggcttccatgttcttaattgtttactgtacgttcgctattgcagtttttttctggatattcggttacgttaaaaccgccgtcatcattggtatactggcactgagcttgattgcttactccttcattcgccgagagattactcgacgacgtttgctcaagcgacgcacggttaccaataaaagtcgttaaaaaaattccaacacgccggtgtcggaattttttggttatttttgcatttgtgataaacaagtgacgatccgctgagccgcctcacgcacattttgcggattagtcgctaagttcaagcgaacaaacccctgatcatcaggactaaaccactcaccaaagtcaactgcgagctgacattgatcttgaataaacgctttcgttgcagctggctgaacgtacgcacgtaaatctagccacgtcaaatacgtcccctgcaaatcggctaaaaccaacttaggcgcgtgggcggcaaaggtggtgcataaataatgataattatcacggacgattgccaaaatctggtctaaccaggccgcgcccgattcataagccgtttggccggcaacctggcctaagacgctgatctcagtctggctgaagcgcccgatttgtgcatcatagcgttgtcgtaattttggattaggaattactagatgtgagttcaaaagcgccgccagattaaacgtcttagacggtgcattgacgacaatcacccggttactaaaccgcccattggctaccgttaacgccgatttgaacggatggttggtccgatcaatttctaaatcctggtgaatttcatctgaaataacaagcacatgatactgttcacataatgctaacagccgtgtctcttcatcttcagaccagatccgccccacaggattatgtggcgaacattgaatgaacaaccgcacctcgttcgccttaatttgctgttccacatcttcaaagtcaatcgtatagtgaccacgatcattgcgtaactcagatgtgaccagctgacgatgattatcccgcaccgcgttgaaaaatggatagtacacgggcgtcagaatcaaaacgccatcacctggttgcgttaaaatattaacgagcgcgtacaacgaattgaccacgccactaccaaatcgaatccaatcgcgtttcaatgtcagaccatggcgtgcctgttcccaatcgataaaggcttgataataacgatcaggcgtaatggaataaccataaatgccatgcgccactcgttcttgtagtgcttgcgtaacttgttctggcactttgaattccatgtcagcgacccacattgccaacaaatcaggattgccataccgagcttgtagtgcgtcccacttcaatgaatccgtatgctggcgcgttgttgcgtacttcttaataaatgctgcttgttccatcttaaaggccttctttctcaacaaaaaaacttcatccttaacttactaaggacgaagtttatactccgcggtaccacctattattacagtcttgctgtcgctcacgcaacgtactcgttacgttcaacccaattatcggtggtcaatccgggctaatagcatcaaccattagccaactccgagttcatcttcacaataagctgatggtcaaattacaccactactttgactcgctaggcatcaacttattgttactcttctcatcaacatttaatcttcacgttgcttctaagttacaacgtgaagattaaaaagtcaacaacgtctttaaaattgcgcttgctctaaaacctggtagccatcgattcgttggtcagcggtaggaaacgccccggtctgtaagaaacgcttggcctgcatgacccgcggcgaactattcgaccaatttaattgatcaagtggcactcgagcggcccccgccgacattgattcggtgtaatgcggtcgtttgagcaacaaatggccccccaccggttccagtaaataataaatattaattaacgttgctggcaattctaatgttgttaaggctggaatcgtaagctggacggtcccaagttgctttgaaataacagtttgtagtcctgtttgaagttgtgcaatctgactaacggcctcactcaacgtggcccgtgtcgtcactggtgcggttactaaatcataacggttcttgaacggcccggttaaggatttattaaggaccatggccgtcgaatcaccaatgataccacaaacaaatagtggactaattgctggttcgttaatcatcaatcttttccttctctcagtcatacgattaaatagataaattaattagcctataaaaatataacagttacattttaccttagaattatgataaggttcctaaaaaaagcatgcgaatatgaatatttaacaacttttaataattctatgaaaaaaaccgaatcttggctactaaaacgcacaaggttcgattactttttttgttatttagttagattgcacatcggtcgtattaataaatgactgggctggcacacgaattaaccaccgcgtcatggcttgatgccccacatggacacctaagccattccagaatgacggctgataagtggctgtcagcttcactgcgtaggctttttcgtgctgccggtcttctttaaccagctgcttttgtgaccacggaataccagcatccgccactttaacttgtgaaagattagtcaccacggtcgccttgttacttgaaacagtatatttcgcaccattaacccagtaattataaatatgcacgggtttttgggtcgtgcctcgatccaccgcgacatagtaggaaccattagttccaactcgcaaaaccagtggttcaacttgatacgttaccttaacgtccttagcatctgacaggtcgacctggtgattgaaagtcacgtatcccatgccaactagtaatccgagactaacgattaattcaacggtggttatgataagatttccccactcaaacgtatgcttacgttccacgatcatcttgatgcgtcgtacgcgaatatgatgaaatacccacacgactaacgccaaaacaatgatccacgcaatgatcccaatccaattccatgcagaagtcattgattgccaaccctttctcaattacattattatgttctaattgtaaataatccaaccttaaataacaagtaatccagcaaattcaacacaatcattcagaagcagattgtgaaaataatcactgaaacggtgccaatgtaatcgaattcatggtaaaataaagttattaacttgtagaaagaaggagtacacatgatcgcgtcactaatttattgggtcgtcgttgttggcttgattgtttggggtgtttggatggccatcctttccgcatattgggccagccaaaaacaaaacggcaacattttctttattgcaattatgaatacattaggtgccttggccggcctcttagtatggtgggtcttcaacaatcaagactggcagtactactggttatccagcaccgttaagacaaccaacctcttaggcatcgtcctaatctgctacgttgtcttgattgtcatcgaattcatccaaggccggggcatcaagcctgagacagctaaataatgattattttaaacgccaagcaagttgctaggcgttttttattgtcaaatgcggcaacaatcttgctcttcagtgtttgttacggtgataacatttgatttgtcatgctgcatgcttcatcatgattaataaaaaaaacgattctcaaagacattgagaatcgttttttgataagcgactgtcctaatggcggctatcggtcttgaagatttcaactgggaaacacacagaacgctccaccagtcgacttgtgacactacttcacaactaagccacggttaattcaaagcctcccggtgccatctcatttgcggtaatacccgctgttaagattggcgatacgccacttactgttgagactgcctgtgcacctaaattaaagcggccttgaatcgtctgttcaacatccgtccgcgttaagattaagcagtgaccatcaatcgtccatgtcaattggctagttgctaaaaagtcggcctgttgccggcgaaacttgatcaaacgcgtgacaaattgtcgaacttgttgttcttgctcgtctggttgccagttcatgcaccgacgattgtcagggtcggcgccaccggctatggccacttccgttccataataaatacacgggctccccggcaatagcatcagtagcgtgagtgcagatttaaatttagttaactgaccatgcaacgtggtcagtagccgtggcgtatcatgcgtatccaacgcgttgaacatcgcctgttgattaggttgacgatacatcattaattccagattggttttaccaacgtaatcttcaaggttgagttgaccattaaacaacgccagaattggttgtgtcagtggataattcataaccgcgttaaactggccgttaccgactaacgattgactactatgccaagactcacctaataggtacacatcaggtttgattgcccgcaaggcaccacataacgctcgccagaaaccatggtcgacctcatcagcaacatcaaaacgccaagcgtcaatcccgaattgttcgatccaatatttggtcacatcaatcaagtaagcttgtaccgcggggttctgggtgttaactttcggcatcgctgctcccgtcgcaaaggtttcataattaagccgcttcgtcttcggatcacgtcccaccggccagccatgaatatgaaaccaatcaacaaaccgtgactgctcgccatttttaatcacatcttgccactgtggtgactgctcgccaaaatgattaaagacggcgtctaacatcacgcgcataccgcgcgcatgggcgccatcgactagcgcctgaaaatcggctttcgtaccaaagtggggatcgatttcaaaatgatcgatcgtatcatacttatgattagatggtgacgtgaaaatgggacacaagtacaggccattgacccccagtgcagccaaatcatctaaatgcgctgtaattccgggcaaatccccaccataaaatgaatcacggtgaacacgcccagcaccccacggttgaacattagccgggtcattttgccgcacaccatttgcaaaccgttcaggaaagatctggtaccagaccgtctccttaacccatgccggtggcagctccgcatcactgacgtgcatatatggcatgtgaaaatagttgcccactgtttgccagttagtggcaacgtcgtcaaagaagccaccctcaccatagccaaccgtcgcaccggtcgtatccgtgatcagaaaggcatagaccacccggttagtcggtacggtcagcgtcgtctgccagtactggttgccctgcgtcgctaatccgggctgcattatccgccgctctagcgctgttgttccttcttgccataagtaagaatcggcaaataaaatctccacttgggcaacatcgtcacgcgcagtttgtagtcgtacctgtagttgatgtgcggctaagacggctatatcttcactttcagggcggtgcctaattccagctagttgcattgtaagatctccttttatgtaaacgattacattattaactagaccatttacgtcaattatcctcatgattttggtgaaaacgtccccgttcgcctcgattttagtgtatcatttagtcaaaatcagttgaaaggacgttatccatgaaaacactttatcgcagtacccgcgaaactgcaagtcacaccatgacgtcatcacaagccgtacttcaaggcctgacgccggatggtggtctctttgtgcccgtaacgctaccgaccgctaattttgacttcgaccagctcgccacgatgagctaccaagaagttgcttacgaggtccttaaactcttcttcacggattataccgctgatgaattacacgcctgcattgacgcggcttatggtgatcagtttgatgactcccaaattgcgccggtcaccaagcatggtcagcagtattaccttgaactttttcatggaccgaccattgcattcaaagacttggcccttcaaatcctaccgcatttgatgacaacggcagttaaaaagaaccatttacaagccgaagtcgttattttagcggccacctcgggcgatactggtaaagctgccatggccgggtttgccaatgttgatcagactcgcatcatcgtcttctatccaaaagatggtgtcagcgcaatccaaaaacagcagatggtgacccaaaccggagccaatactagtgttgttgcgatcaacggtaacttcgatgaggcccaaacaacggttaaaaaactgttaaacgaccaccaactacacgcggaattagccacccaccagttccaattctcaagcgctaattccatcaatattggtcgtttattcccacaagtggcctattatgtctacacctacgctcaacttatcaagcaggggcaaatcaagaacggtgatgagattaactttagtgttccaactgggaactttggggatattttagctggctactatgccaaacaactgggcacgcccattcataaactgatctgtgcttccaatcgcaataacgttctcaccgatttctttaataccgggacttatgacaaaaaccgtgaattcttcttgacgagttcaccgtccatggacatcttagtctcaagtaacttggaacggctcctcttctacttgacaggatcagacgccacggcgactgctaaactaatgactgatttgcaaacgaccggccgttatacgattacaccggcaatgcgtgccaacttagctgatttttgggccggcttcgtgactgaaagccaagatcaagctgaaattcatcacctgaaccatgcccatcactacacaatcgatccacatacggccgtggcctcggcggttgccaaacagtatcaagccgcaaccagagatcagcggcccatggtggttgtttcaaccgctagtccgtataaattcccacaggccgtcctaacggcaattactggtgagcttagtgcggtagatggcctagccgcagttgatcagttacatgagttgattcaaacgcccattccaacaacggtcacagccctccgtactgcgcccgtgcgccataagcgggttgcggatgttgatgatatgggaacgaccattaaaacaattttaaatcttaactagaaagtgtgaccaagatgattacgaccattgcgttagacctagataatacgttactaacttctgagaagacgatttctccgcgaactgaagcagttctcaaacagctgcattcggccggcaaacggatcgtactgtgtactgggcgaccaattaaggcgattcaaccatacttacaacaacttgaactcaaccaaccaactgactacgcgattacctttaatggtgggctcgttcagcaaaacacgactggtgacgtccttgctcgtactagtgtgaccaaacaagatttacaacccttatttgagcaagcccagcgcgatcatttctacttagacgtgattgatttgaagcaagtctactccattacggatctaggcaagtcaccgtacgaagaattcttgcaaggcttaatgccatttaagaatgttcgttttgccgacctgcctgctgatgatctattcggtaaagtcgttagtgctggtcaagatgctaaaacagtccaggccaaattaccaagtcaaattaccgatttcttccacgtggtcccatcccggcggactttgttggaattcttaccaccgcatactgataaggccagtggtttgaaacaactcctcggtcactttaatgaagactatgacaacttgatggcctttggggacgaagaaaacgacctaggaatgctaaccgccgccaaagttggcgtagcgatggcgaatgcgattcctgcggtcaaggctgcaaccacccatgccaccctgagtaatgacgcggacggggtcgccgttttcctagaaaattacttcaactgatccccaactgaagcctgtaacgggcttcttttttagcacaaccactcaaaatcaaactaacgaggtgtcccatgcaagatccccgcattatcccagcagaattaacgactggcgcttttttcgatattttagcagatgaggaccacagcttaagttatattcaggttagtgaagaagacgtgagtcaccagcacatcgagcaccccatgctggatcacgtgcacttcgaaaatgtccggtttacggccagtcaatttgaacggcttgacttgaccgatgccatctttatcaattgtgacttttctaattgccagtttgaaaaagccagctggctacgcgttcaattcaaagattgtaagctcgtcggtgtcgacttgaacgaggctgccctcaataacgtcgcctttgaccactgtcagctcgacttagccatgctgtgcgacatgcggttcaaaaccgtgacctttgatcactgtcggctgaatggggccagctttatgaacaatcgactaacgaccgtcaagtttaacgaaaccagccttgaccaagtcgctttcaacgataccgccctcaaaaatattgacctaagcacctgtcaattcgagcgtctcgaacttgatactgccgcagcacgcggtatgatcgtcaatattgatcaggctgcttatttggctgctgctttaaacggcatcaaagttaaaccctgataccggtggaacagtcaccgtatgagtgaccaactcacaatgccaaggacgattaagctgctggctggtaaatcttctaataacactgcacgtatctgtcagaatacttttcacgcgctgaacacaaaaataccacctccgtcaggtaacaacctgcgaaggtggtattttgtcgttcatcatgacaattcgaattgcgccccggtgtaaccagtgcggtcggccgccgtgattggtcgaataacttggcaagggttgccagccgcaatcacgttagctggaatatcgtgggttaccacgctcccaccaccaataatcgtgttagcaccaatggtcactcctggtaatacggtgacgttagcggctagccaacaaccatcaccaattgtgattggtcgggcgatgcagccgcccctaattcgttcggttgcatcaaacaagtggttgctcgtgtaaaggccgacttttggccccaacaagacctgactgccgatcgtaattggcgccccatctaacattacacaatcatagttggcataaaagttatcacctagatgaatgttccgtccaaattcaacgcgaaaattaggatttacaaatggcttgcgaccagctgaaccaaccaattgtcgcaataaagtttctttagtctctggatcagcagtcgcattgaccgcgttcgttgtcaacgtcgcttggtcacgcaacgccgttagttctgcatccgtatctcgatacggctgaccagtcgccatatacgcaaacttctcatctaaattcattccgcaccccacttctatcgaataaaattcaagtaccatgttattgcgcagattccttgtgctgaacgaatctggccattctttaataggtcaatcactttactgagcgggacaagttgcgtattcacgtattcgtccgcgtcaaaatgtcgttcgccatgttcttgcggatcaatgtgagtcaaaatcaagctgaccgtttcgtccgtgaaaccttccgacgagctaatttgcgtcataatttgtggttcatgggcaatgtagcccgtctcctcttgtaattcacgggccgcggccgttaacggatcttcccccgcattaatgaggccagcaggtaaactaatcgtctcggcattgcgaccgacccggtactctgaacctagcacgacttgatcatccgcagtgatggctaaaatcgtgacggcgttcccatgctgaatcaaatcgcgttttacttctaatccatcaggtgtttgaatcgtttgtttgaccaaatcaaaaatcggcccatgatacaccggtgtcgttgataggaccttaccaggccggccaactttctcaaataaatctgccatacacattcactactccttaatctatctcaaatccggtacaccatccggcagcatcttacgaatgccacccgcggggtctggcacgtcaccttgatatcgcggtatcagatggagatgacaatgcattacggtttggcccgcagccggatcaacgttaatgccaatattatagccatccggatgattgtgcgcatctaggtacgcttttgcttgggtcagtaaggcgagcatcgcattcctggtcgccgtgggcacatcaaaatacgtggcataatgtgctttcggaataatcaacaaatgccccggactcaccggctttttatcgaagaaggccgctgctaggtcattctccaaaatatacggcaacggctgacaaaaaatacaagccataccaaagtccccttcctattttgctaaccaaccaccatcaattggaaccaccgtcccatgaatataatcagcgtgctgactcgctaagaatagcgtcagatctgcaacttcctgcggttgggcccaccgttttgcgggcgtctcactggcaacccatttcgccatcttaccatcgccagcaaaatcagcggcattcatcggggtatcgatagcccccggcgcaatgcagttggcgcgaattccctgagccgcatagtccaagtcaagttgtttcgtataaccaatgatggcgtgtttggctgcggtatacgctgcgccgcctccgccacccaccagtccagcgatcgatgccatattcacgaaaacgccgtgttgtgcggctaacattgcaggtagcaccgcattagtcacgataaactggcttgtcagatccgtcgccaaaatatcttgccacgttttcagatccgttgctaaagttggttgataaccgtctaacttaccggccgtattgcacacgacggttggcttgccgagtacgttaactcctgatttaatcgccgcgacgagcgcattagtgtcggtcacatcagcaatttcatagcgcagggctgacgtcgttactagcgctgatggctgtggctgccgatcaatggcaatcacgtcagccccctgggctaggaaactctggacctgggctaagccaatcccggaggcagctccagtaaccaagacagtctgtccacgatattcatcaaattgcattagtcaaccaactgccagtccgtcgctaaaatatcacaatccgttggtgaccacatactataggcttcatcggccgttttgattaaaaagtacgggttcagcgggtcgccgttgaaagtggttgccgtctgtaattcgacgaacaattcggtcccttcccaaccagtccgaacagcgcgcttaccagcttttaattcaggtaaaatagcttcaaatgtcatcatgatacctccaattattaatacccaaatcgtatcataatcccgcgtggagtgacaggcaaaaattggtaccaacaaattgtctattttactggtacggaccaattatttgtgcgataatgtaagcgaatacagaaactaattattatttggaggaattttaaatgagtaaactcggtgtttccgtttatcccgaacgatcaacctttgaaaaggatgcggcgtacctcgatttagccgcaaaatatggctatcaacgggtattcacttcactgcttgaaatcaaaggggaccaagccgcagtggttgccaactttaaaaaagtgatcacttacgcgaaccaattaggcttgcaagtaatggtcgacgtcaatcctgacctcttcaaacaacttggcgtgtcctatgacgacttgtcattcttccacgacctcggtgcctggggtgtccgcctcgacctaggattcactggtcaagaagaagcccggatgacgcacaacgaattcggcattaagattgaagtcaacatgtccaaagggactcactatgttgacacgattatggattattcacctgaaaaagataacttactaggctcacataacttctacccacaacaatacactggtcttggttatgattattttgttcagacttctgaacaataccgtcagtatggcatcaacaccgccgcgtttgtttcatcaaatgatgcgacttatgggccttggcccatgcaagacgggttatgtacccttgaagatcatcgggggttaccgattgcggcacaagttcaacatttgaaaatgacggggctgatcgacgacgttttaattggtaacgcctacgcgagtgaagccgaactaaaagcggctgctgaagtgttctttagtccttacccactgctacacgtcgaaaccgttgctgatctatcggcagttgaagaaaaagtactctttgcgcaaccacagacttatcgcggtgatttttcagattacgtcattcgttcttctcagacccgggtcatctacaaagacgaagcctttcctgctcatcacctagatgccattcataccggtgatgtcttgatcgataacgatgagtttgggcaatacaaaggtgaattgcagattgcacgccaaaatcttgaaaatactggccgaatcaatgtggttggtcatattaccaagagtgacttaccttgccttaacttgttacaaccgtgggccgactttaaatttgtcgctgccaaatagtactcagcgaatggaggggtcgcattaatgacaactgattaccgtttaactagcgatgctgaccgcgaagctttctaccaactttatcaatacgcgttcaataatcacgatacccccgcgcggcggcgatttttcatggatcgctaccaacatggctggatctacggccgtcacgatcatggtcaactggtcagtgggctatacagtctgccactagcagtcaactttcatggtgtcacctaccggatgaatggtattggcgacgtgatgagtgcgcctgaatatgccggtcagggtggcgcgggacagctgttaacgacggcgctgacagaaatggcagccaaccacgtgacgctgtcctaccttgcccccttcgcgtacggttactatcgtcgttttggctatgaacacgtcttcgaccacgcgcaccaagtcatggccgctccagacctaccacgtgtcaaaccgacggactggtctggtacgatcacccgctatggcaatgacgggctggcccaaatcaacgatttttatgcacgacaaccgcaaaatcagcgtggtggtctgattcgaccagcctggtggcaacattacctgactctcaaacatcattggtcggtcgcaatttaccgcaatgcggctgccaatatcgagggctatttgatctatgaacggcaggccactaactttgcgattcaagaatgggtgactagcacgccgaccgctttcgaacgattggctaactttatcactaagcatggcaccacctttgaaacgtttagttatgatagcccaagtgcgaccaacggcttggacctactagccgacccataccgtttaaaagtgactgtccagccgtacatgatggcccgcattgttgatttatatgactttatcaagcgctatccgtttctcacggacatccaaccaattcgcctagcagtcagtgacgctaccctccctgctaatcaaggaatctggtcattgacgcggcacaacgggcaagtaacgctcaatcgggttagcgaccaattaactggaccggctgacattcagttaacgattcagcaattaaccactgcttgctttggcacccagagcttagcccgggcgtaccaacacggattaatcaccggtgatgtgaatgcgatcaaccgacttgacactagtctagttaaagaacgaccagcacttattgactacttctaagtgcttaatttagataagcagcatgactgactcaaagtgggccgccagaataatcattctggcggcccactttttgttcagacgctgactggtattgagatttgcatagattaagtcatttacgaatcagatggcaacagatactagcaccagtcgattaagctggagccgtgagcaaatcaacttaataataatgaattgccctcaaatcacggacctcattagtctccatgtttaagctaccttagcaaatacgttggttatttactcgacaggaatattccaacgcagtaggcttcaattgctattagaaagtgaggtcattattcgaataaatcacgttaatcatgatcatgctgtcgctatcactgcaacgccaacgacatttcccactaatacattaaacaaattatgccctattaccacgtgacctaaaccgaatttgctgaacacactgcaatctctaaaaaacaactgtcatttaccttgaaccgacgagccttcatgattatccttgtcgcccatcaaattaaaccagcaactagtttaaaagcacactgttgaatggcactggatttgaatatcgacttacaaactatcaaccataattcgaatccgatgtgattaaattcgaatgggcgactgcttaaatatgacagcaaccactatttttccaaaaagatctgtctttttcatttgagcaatcatgcttaatcttccagatatattcagaatcttcaccaactatacaaatacttaccggctacctgtttcatcatgactaggtgctgtctagcgaaaattgacaattcaattaaaaacattaaaattatattagattatccgtttttcatttctaatcaattcatactaccgaaaggaactcgccatggccatcaaacaacctgatttaaccatcaacattagtaatcatcaatctagcttgcaaatcttcaaagctgccgcaagtaatttcattagttcactaagcggtaaaatgttcacttttggccttggactcatgttactcgatgaaacacactctgccattagctttggtatcaacatgattatcagtccaattgttggcttgctttgccttgtcccaattggcaatctgattgatacttatccgcacaaaaccgttctcactggtagcctgactgcccgcacgcttgcactaattttattcgctgctagtatcaacttatttacggcaacagcaaaactcattccaatcgttctttttctaattatcgatgcaatttcgacaaatattaatgatacctgttattctgccgccacccatgagcttgttaacgctcacaacattcaacgtctaagttcattaacccaaagtgcaatttctctttcctcgattctatcaccagcgttaggcgttgggttatacagtttagtcggcttttctggcttcgttatattagagattgttgccacactcgcctcatttggcattatgctcacaatgaaatttcattatcacgcaactaatcaattcgctaattcacaacacgccccagtaacttcgcacagtcagtttgcaaaatttcattctggtctaaattacatgcggtcgcgaacaatgattaaaattacaattctgttgagtgttattctgaacttcttatatactgctgttacgattggaattccatacatcttaaaagatcagcttcacacaggtaatggtcctattggcgtgcttgaaaccgggagcgcaattggtatgctacttggcagtctacttttaactttgctaccgccaaccggtcagaaacgtctctttttaaaattaattattccggtacttattcttgatagccaaatattgctattaggtgttctgttcatgacgtcccaatcaccaactggatatgccctgcttggtagctttatcatgggaatattggctttcgcgcttgttattcttaatataacttttcaggtctacttgcagcaaaccgtgccaactaaattactaggccgagtcgttgcaacattaacaacagtcaatagctcaatcatgccaatcggaacacttatgttcactttaatctttcaaagtaccactcatggcggtctcgtactaatcatcaacggaattctactacttgggtatacgttactgctgttgcggccattaaatcaggccattcatagtgaacagccatgagtcacgtatcatcaggcaattaacaatcccgattgcgatggaaaacgttgctttcgactttcaacgggctcaccaccgtgcttctatcacttcgagccctcataaaaccgccaataaacaaattattgattaacgaccgacataatacctaggaattataccagccaatgttacgatcaacatcacgaccaatcgttatgaacaactagcgcttttgcaacggcaaatagttattctattcaaaaaagatgtttgaagatccgactagatctccaaacatctttttactgacattatcctggttaatcaccagcatcgtgcgtaaataaaactaacgaatatcaattgattaccaatgtaatattaaccatgtcttgacattaattttcatacaaataacccgcatcccgtaaagctgccttgatggctgttaattgttccggggtctgataagcaaccgtatggctatggacgccatctgttaattctgataataaatggccttgtaatttcttgagccggcccataaacagattaacatcaccaactgagcgaatctctaattcaccccggagccggccatacaatgggtgttcgacttcaacatccttgattatgccccctgcgtgaatgatcaaggccatttcctgcatcgcttcgtttggaaaatgacggcaaactaggacagcagttggctgatccgctttttctaattcatacccttgaagagtagcaacaatggccgttccgtgagccctcaataatgaaatatccccaacaatggtctgacgactaacgttaaactgcttcgctagcgttgttgcacttacggggacctgcgtttgcgataattttgatcgaatttgttcacgccgttctgatcctgtcatgactcacccttcttactctttcaatagaatcattctaccagaaaaccagtagaatagctttcatcaaatactaaattatgataaactaagttcatttaccataggtgtcaagacacctaaatcttaataacgggattgattagcaatgcgcaatttatctttattaaccgacttatacgaactctcaatggcaaatggatttcatcacgacttacctcagaccaacgccaccttcgaccttttttatcgccgggttcctgacaatggtagctttgtcattgcggccggcctccagcaagttgtcgaagctttacaagattttcattttaccaacagtgacctcgactacttccgtcaacttaacctatgggatgaatccttcttagccatgctggcaaattttaagttaacttgccaaattaaggcactaccagaaggaaccccggtctttcctcgtgaaccactattgacaatcactggaccacttgagcaagcgcaattacttgaaacactcgtcttaaatatcgtcaatcaccaatcactgattgccactaaagctcgtcgactgagttatgctgcggcaggacgtccaattatggaattcggtgcgcgccgtgcgcaaggcccggacagcgcgctttacggcacccgggcagccattattggtggcgccaatagtacttcaaacgttctcgctgcgaagctgtttgatattcccgttgctggtaccatggcccacagttggattgaggccttcccggatgaactaacggcgtttcgcaagtgggccgaacaatatcctgacaatagtgcgctactagtcgatacttatgacgtgcttaactctgggattcctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacttcgctgttgcacgaaggcgcaccgatcgataattttggtgtcggtgaaaagctcatcactagcgcgtccgcaccggttctaagtggcgtctacaagcttgcggcaactgagagcaatggtcagagcacccccaagatcaaggtcagtgccagtcgcgaaaaactaacgattcctggtgataagcaagtctatcgtctgtacgaaccaggaactcagcgggcctttgctgacttgattgcactagctaccgagacgatcgtcgatgcaaccagcctaaccgtcgtcaacagtgacccactcagtgtcgaccgccaacagcgactcacccattttgaagcccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacaaccacactcagccagttacaaactagtttgttgaataaaatgacgatactagcagattaacaaacgaacacgcgtagcaacgactaaagccacttctgatcagcgttcaaatgaccgcttagtacagaagtggctttagtttataacaagtaacagttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatctgcttttagttgatttatgacacttcccatctgcttgaccatcttaggcgcaatctggctaagaatctgttcgcgtcgttcggcgtcaaaagctgccatttcaaaaatgacctttaactctttcacgttagctttagcaaatgcaactcggtccgtaaaaattgctgtgacgaatgcctgtagactgggataacgctgccgtaattcatcctctgaaaaatcactcgctaaaattggcacaatgtgtgcggcaattggtgctaagatggcatcccgtaaggcagccttagtcttataccgccgatagaccgtcccctccgcaacgccggcccgttgtgcaatatcactagtactagtctggtcaaaacccttttcagcaaacaaatcgagacttgcctggaggatggcccgttgcttaggtgtaatcgtttcattctgacttagatcatgttgaaaataatcccgtatccgtggtcgttccatatcctcacaccttccgataacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactcgccatgccatcgactggaatcaacccagcaaaaaagatttgtggtacaacaatcagtggaataaactgaatcatttgaaattctgagttagcaaaggtggaaataaagatacccaaggtcaaagccactaacgctaataataagttagtcagaaagaccagccaaatactaccaactaagtgaatcttgaagaccgtaattgcaaaaacaacggtcaggacagtctgaatgatggcaaagcccccataaccaattagatagcccataataatttcactccgtcgaattggagttgcaagtagccggcttagggttccagtagtgcgctcattcaaaagtgaaacgccagaaatcaagaacacaaagaagaagacaaagaaaccgagaaagattggcaaaaagttttcaaagaacgttgaatcactactaccataaatataatgactgctagtggtataggtcgtcgtttgtgattgactatttgttggcgccgcagcactcgctgtagcctgcctcaattgcttttgaattttagccgcagcagcagtattcccacttgcctgtgcttgggccaaggccgtctttagcttgctaaccgttgcctgtttttgcgccgcggtcaacttttgtagtgccacctgttgcgtttgcaacacctttttttgtgctttagtagccgtgaccaacgtttgaatttttaatttgaccagtccgctttgcaaagaagctttgatcaatgacgtattggtcggattactattagaatacgtgatcgttaagttgccatctttttgcgtcaaatatccatccaaatcatgctgcttaatcatcgcttttgcctgtttactactgtaatggtgaatatcgacatgcttcgtattaatggctttgaccacctgatgatcaacattgtgaacacctaaagtcgccacttgagtcgtgttattttgaaacaaaaaatacatcaacgccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccagtatccttgagcttatttagttcggtccaaatttgttgccgtaattctggatcaatcccaacggtcggttcatctaaaatcaataattggggatcctgaatcagggcgattgccaacgacaagcgccgtttcatcccacccgaatagccactgacccgcttgtctaattgggacgtcaagtcaactaatccggctgcataatcaatcatctgtgctaactttatttttggaacactcattaattgcccaaaaaaggtcaggttttcacgggccgttagtgtctcatacaaggcgtcactttgggccatataccctacttgtgccattaccgccctattgggcatcaccgtatccataactttaacagtgccactatccacagcttccatccctaaaatactcttgatcaaggtggtcttcccagctcccgatggcccaatcaagccataaatcattccagccggcagtgtcaaatcaatctgattgagcacttgctgatgaccaaagtgcttgctgacctgcttggcgatgacataatccgttgccattttaataaccctctttctcgaagtgagtgcatactcactcacttaatggctttagtataatcagtacatctcggtttgtcaacagcaaaaatgagttgtcactcacttactttatttccagcccatttgtcaccgcactgcaaacaaaaatgcgccaccccgttgttgggatgtcgcattttaattaaatatcagcactgatataagcgttagcaatgttttaacgattgttaatcttggtcagcaatttttgtcctagctcataatccaactgacgctccgattccggcatcatgtcgccgccagttgcccagacaatgtgggtgacgtctttgccagcaagcgtgggaaattgggccatgatgggggcgatcgcggtaaagccggctgcagcggatggttcgaccattacatcttcagtatcgacgagcttcgtcaaataacgatataaatcatcatcttcaaatgttgctgttccgagtaatagcgtttgcatcaccttgcctgccaaccgtgatggccggctaacggctaacccatcagcggcagtcaggccatctaaaccaatgtcttgaacagcaattttttcattcagcttggtcatcatccctaaggtcacggacggcacgtgggtcggttcacaaaagacggggtaaatattggctcccataatcatcttgaggccaaaagcgacgccactaggactgccaccgaccccggccggtaaataaacgacgaccgggtgcgcagcatccatcttgatgccttgtacttttaattgatgttgtaaccgtaccccagcaacagcgtacccgaggaataagtcacgtgaaccttcatcatcaacaaagtgcgtatggtcatccttggccgcggcggcacgggccaccggaatcacacttgaaaagtcggtatttagttcctcaacggtgacgccatttgcccgcagtttgtccttcttccactgacgagcatcgtgagacatataaacggtcgtcttaaatccaaacgttgcggccatgatgcccacactgagtgccaagtttcccgtcgatgcaacgatgacgccgtattgtgcaaataactcgtgatacttagccgttgccaagacactgtaatcatccatatacgttaaatccgtatgggccatggctacctgttcagcaaacttgagcacttcgtaaatcccaccacgtgacttgatcgaacccgaaatcggcaactgactatcagcttttaaataaagctgccccgccaatgactggtggttgagagcctcccatgctggtttcatctgctcaagtggtaacaatggtgactcaataatcccattcatagctgccgtttctggaaaagcaacggccaaaaatggtgcgaaacgttcccaacgtgcgaccgcgtcaaaaatatcggcccgcgttaacggcaggtccgcccgcttcccataatctgggttctgccaaacaattggtcgttttgccatcaattccttaatctgtgggtgttcttcaatcattaccgttgtatccatactttcaggtccttttcatttaattgcatcatattacgtatcgtgagttaaaattatcagttttcgatggccgtctgcatgcgttcagcctattccgaccttccgagactaggtaacatactgaaacgtcaccacgatcagcacaaatgccgataagtcgatataacacgcactgagccaacaagcctcccccaacccgaccctttcaaccgaacctaagttagtggcttttctctgaatctaacgatttttaatcacaactcatgttagataatatgacatcaccttcgtccatcatttaaccatatttgatacttagaaacaatctttaggcactgattaacaataattgttgattagccaatcaaacaagctaataaggcaatcgaaaaacgacgttcaaagttcactcactttgaacgtcgtcttcaattagtggttattaattgactaataatcgtcgttcgaactgcataatcattcagtagtcttctagcacaacgagtttcctacttcaaatcggccccattcgtccgaatcactttttgataccagtagaacgaatccttcttcgagcgctctagtgtcccgttaccttcatcgtccttgtcgacgtagataaaaccgtaacgtttcgacatctgaccagttccagctgagaccaaatcgatacacccccacggcgtatagccaatcaagtcgaccccatcttcggtaacggccttgatcatttcactgatatgagcgcgtaaatagtcaatccggtaaggatcatgaatactaccatcggcttcgactttgtcgcgggcacccaacccattctcaacaatcatcattggcttgtgatagcggtcttgtaaccaattcaaagaataccgcaaaccttctggatcgattggccagtcccattcgctcgtcttcaaatatggattatcaacggcttcggtcccgacaaagtggtaacttgggttatcatcctgagcggcgaccgtgttggaattatagtaactaaagccaatataatcaacggtgccttccttcaagacttggcggtcttcggccgtgatatcagggcggaaaccagtctgtttgaagtaagcttccatattatttggataatagccccatgactgtacgtctgcaaaccaataacgccgctgcatagccttttcagcttgcatgatatcttgtggcttagcagttgcaggataaatcggtgtcatgttgatcatattgccaatctggaagtcgggattaatggcatggccaatcttaacggctagcgcactggcaacgacttcataatgagcagcttgatacatcaacgcttcagcgtcaggatcatcgggcttcaacactaaaccagaatccgtcgccatcaggaattggttcgtataagtcgtctgattattaatttcattgaaggtcatccagtacttaaccttgttcttatagcgcttgaagaccgtttcagcatagtgcacaaaaaagtcaataactttccgcgaacgccagccaccatattccttaactaagtggtacggcatttcaaagtgggccagcgtgatcactggttcgataccatattgccggcaagtatcgaacatatcatcatagaacttcaaacccgcttcattgggttcttcttcatcaccatttggaaaaatccgcgtccaggcgatcgatgtccgaaaacacttgaagcccatctcagcaaatagcttgatatcttccttatagtgaccataaaagtcgatgccttcatggttcgggtaattcttacccgcaatcacaccatccgtgatttcacgaggaacaccgttggcaccggcagtcatgacatcagccacactgacccctttgccaccagcttgccagccgccttctagttgatgggctgcgaccgccccaccccataagaaatcagatcgtaaaccactcgttgttgccatgcattatcatcctttcactataaatcttcaccatcactcgcaataacttgttggaaccagttaaaggagtctttcttagaacggtcaaaactgccttgaccattatcatcggcgtcaacataaatgaatccataccgtttcgccatttcaccagtacttgctgagaccaaatcaatacagccccacggtgtatagccaatcagatcaacaccatctaatacgaccgcttgttccatcgccaagatgtgatcacggaagtaactgatccggtagtcgtcatgtacactcccgtcggcttccttcttatcgtaagcaccaaagccattttcaacaatgaattgtggtaagtgccaccgatcttgcatccagttcatcgcatagcgcaacccagttggatcaatttgccagccccaatcagacttctcaacgtaggggttctcaacaaagtcatcgggttccttgaaatcgtaatcactgtcaccgtcacgaccctttgtaacaaatgacatgtaataactgaaaccaacgtaatccaccgtaccagcctttaaagttgccaagtcagcagcggtaatatccatatcgaagcccttgcgttcaaagtacttcggtaaccactttggatattcaccgagacagtggacatccccgaaccaataccgtttttgcatggcccgttccgccatcatcacatccgctggtttagctgttagtggatagattggacacatcgcgaccatacagccgatttgaaaatcaggattgattgcgtggcccgcttgcacagctagggcactcgctactaattcataatgagctgcttgatacatcgcctgttcccaattgtcatccttgctaagttgcaggccggaattttgtaacaatgggtgcggatcactccaagctgtttggttattgatttcgttgaaggtcatccaatacttgaccttatcctgatagcgcttgaagacggtcttcgcaaaatgaacaaagaagtcgatcatcttacggttgctgaaaccaccataaaccttcactaagtggtatggaatttcaaagtgtgacagggtcacaacgggttggatgccatgcgataataaatcatcgaataagtcatcgtaaaacttcaaaccagcttcgttaggctcgctctcatcaccattcgggaaaatccgggtccacgcgattgacgtccggaaacacttaaagcccatttcttcaaataatcgatcatcttctggatagcgatgataaaaatcattgccccagtgattaggatagatttcaccatctttgacgccatccgtgactttacggggaaccccgttacgtccggctgtcattacatcggcaatgctaacgcccttgccatcaacatcccaagcgccttctaattgatgggccgcgaccgcgccaccccacagaaaatctttgggcattttgtatccttttgtcatgaactaattccctccattaatgctgctcaggctatccctgagttacagtctttgttaccttaactaacgaaaagcgtgtaaccgccacgtcaccgttgttaagctgtctgccattataagcgaccacggcatgaatgaaaaaacaagcccagaccaacaccagcaggtatttgcctaggctcaaattaattaactacttcgcctcatcggcagctaaacgccgataaacgtctacaacttcaccagctaagtcgcggaaggtgatggcattcatgatgtgatcttgtgaatgtactaataacaatgacacgtgggtatgttccccttgtgcttccgccgttaacattgaggtttgtgaattgtgtgcttcggttagaaagttatctgcttcctttaacttggcatcagcggtttcaaagtcgccttccttagcagctttaattgcttcgaaagcggaactctttgcattaccaccattaacgatcaaacccataatggtttcgagacttgcttcaacttcttttgtttgttcttctgccatttaccctcatccttttagcatttattcgtgtgcatcacaatcaaaatgccaccggccgcgattgatctaccgtgggctggtagcacttacaatttaatgattagtttgcttttgcaattgatgcttcggcttcctttaaaactttttcgccgttcatcatgccgtagtcttgcatgttgataacttcaactggaatatcaacgcgcttttggaaatcacttaacatataacgaacttgtggtccaagcattaaaatgtcaggattcttttcagctaacttcgcatcagcgtcactggcagcggttgcaaaaatatctgcatcaatgccttctgcttccgcagccttttgcatctttgagactaataatgacgttgacatcccagcggcacataccaacataattgttctttcagccataataaacacgctcctagattgttttaaatttatatgttacagcggttgctttaataaaccgctttcattacaattagaattataagtcatgggtacaaatttgacaagccttattaatcagatatctgcaatttatttgatttgtacccacaaattattaaataacaacttaatattcgaaagaagtgaacaccatgtatcgtgacattgcaaccaaactcgttgccgccattcaagacggcatttttaccgtcaaactccccacggaagcccaattaatggaacgttaccaagctagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttccaagattctgacttttgatacgatccacggcgatagtgccctgagccgcaaactcaacattcccgtcgacgaagaactgtatcgtatcattcgcctccgctattggcacgaccaactgtattgtttggaaaaggcctactacttacgctctgtcgtcccctatctatcgaccgaagctgtcaatacgtcaatttgggacttcatcaacgaagcttacggcatcgggattgctaacagtgatgattatctttcactcaccaatcttaacaaggaagaggccgaactaatgaatttggcacagggcgcaactcacttggccttggattcttgtaactattataagaataatggcttactagatttttctcacaccatctttgtttatcccgaccttgcattgtattttcatacgacaaatcttgcaaataattaatttatggctaaaaaaagacgattcactataatttcatcacaatttatgggtatactagtaacagtatccaaatttacgatggaggaattagcgtgtcagcaccccttttttcagtggttgtaccagcttacaaccagcacaaatttatagatagctgcttgactagtctacaacgccaaaccttgacagactttgaagtcttcgtggttgatgattgttcgactgatgacactggtgaacagattgccgcgttaatcaaaggcgacgaccggttccacgtgatcactcacgcccataatcggggcgtctccgcagctcgtaactccggtatggctgctgctaagggtaagtacctttgctttgtcgatggcgacgattgggtcgaaccagactttctggcaaccttcctagccgcctaccggtcagcacccgatacccagctcgttgtatgcggtcactacggttacttagccgttccgagtcctgccaaaacatacaaccaaaaagacttgattgccaacatcaactttggcacggttggcggtttttcgtggaataaagcattcattcgcagtattattaccacgcatcacctcaagttcaacgaagatattgattttcttgaagaccagttgtttgcctttcgttacgctaactacgtacagtcctccgaatacgtaccggaccggacttaccattaccgttggcgttttcgaagcaaccttgctcacattggaattccattcttcaccgctcgtcgtaagatgatgaagattctcaagcaggaaaacaagcaagttttgaacgaagattggaataatcagtagcaacgttacgttgccatcgcctctaaaggtcggtagctgaaatagctatcaccctttaggggattttttgatacctagcataatcggctacgatgaccagaaaatgcgcaattattcgaggctagtagccatccactcgcagcctcaaatgcgctttcgccgccgattaaaccgaccgtggcgcgaaacaagctagctgctcaagctctttttgatatcagcgacaaaataaagtggcaattaacaattaaagacttgttgaatgacgagtaacgctttacaattggactatattaattaatttgatgggagggttagcgatggctacgattcacttatacttagtccgtcatggacaaaccaagctcaacgcggccggccgtttacaaggcatctatgattcggaactcacacataccggtgtgcgctccgctcaacggttagcccgcatgctagcagatgttcatttcgacgctgcttacgtcagtgacttgggccgagcacaacaaacgagtcgcattatcaccgcactccatcctgaaataaaaaagccgacgattgacgtcggcttacgcgaatttaacttcggtgggcttgaaggtaccagaaacatgtggatcgtcaagcaagtccaaaaacaattgggtattggaacgtttgttaagttgatgttgagtcgtgaacgcttcgccaccctactatgggtctttaactccctcgaccagactcgtggcgccgagactttggtcggtgtcacggatcgaatcagtagcgcgctacgacgaatctgtttgtatgaatctcaggatagtcagcatgacaagaatattcttatcgtttctcacgggctggttctcagtgcattcctataccaaatcagcccccgtgagcttcccacccgactcctgaaaaatacaagtgttagtcgcgtggactaccaaaatcggcaattcaagttgatcgacattaatatcacccctaagaagcgggcctagttgtctcgatgctaacaggttgcgtggtacaactcggaaattgcaagcgcgcctgaataccaaaaaaggctttgattttgcgttgtaattcttgaccagttgcatgcactgaagcttcacttgcatctggatcgccaactacaattaaaatgcgactgcttttactatccaaattaggcctgattggggtggtagcatccgctgaaagactggccccctgtgccgttaaatgaagctgaacctgctcagtgccaagcgtattcatatcccacgcattgatctgcactggatggcgcgcgtgaatcacttgaagcaagtctgccaaagcattctgcggctgagcaacggcaagcccttgtgcagctaattgtttttcaattgctggattcaactcacggttatcaagattgctcatcgacaaaattgctaatggaatttccgtggtagtcgtcggtaaaatttcaattttcaacagttatcacttcctaaaaacacttcaatactaagtgtgccaaatttgacgtaaaagtcaattaccaccacttaagtcatagcgaaattttaataataccacaaaagcgattcccacacacgtgagaatcgcttttttaatggccttattgtcctcgtcgatacaccgatacgcttgtaagctgaccttacttagtcgttgataatgggtgggccgcgaagtatttttctaagaatagtgccaaaccatcattataattcatatcagttacatagttcgcaactttcttaacttgtggcaaggcgttgcccattgccaccgataagtcagcttctgccatcatcccaacgtcattcaagccatccccaaagacaaacgtgtgggcggcatcgacatgttgctcacgttgaatttgtttgaccgccgtccccttatccgtattcagaggaatcatctcaatattattcgggttcgatgatgaaagtcgcaacaatttactattagtgagcttttcgcgggcagaatccagccgtgacatgtcttcacgactgagaatgacgccgttcgtaatctggtcctcaatcgtggctaattgcgtaaagctcttcacttcttcatagccaatcgagacttcatccgcatcaaagttggccgcattacgagcaacgaaccgcggaatttgttccgtatagtaggccatgtctggcgtgaacaacatcattggtaagttatcacgacgcgcaatcagataggcaagctcaaccgcagcacccccgagtttggttagctcacggccctgggcaccatcgaacaccgccccattagatgtcaccaaacgaacgtcagcgtttactttgtctcgaacgatcttcgccagctcgtacatgcgccccgtagcgatgtaaaataacacgtcctgcttctgaaaccgttcaatcgtcgctcgagttcgctccgagacatattggtgatccgttaataatgttccgtcaatgtccataaagactaaatattttggcatagttgaactcctcctacgtatttacctatatgttgtgctagctaactgatcatctgtgacattcagcttgactgcttttgctgggtttgccaatcagtcggtaccatcctgccatcgtcagtaaatacgcaaattggcgtatccgcactgatgagtaagccggttggccggacttgaatgggcttaaattaaaaagatgacgcaccgccgccttttttagcaatcataattagcacaaggcttatttacactcccaattgtacgctattccctcctataatggaaatcgctttcaaaaccgaactagccaccgcattttcaccacgtaaggcgctaaacaatcttaagtttagaagctatttagagcattatttgccctcatcagctttatataccaaagaattcaatctcactacttgacattcaccagtctagccgctaaattagagaacaattaataaatgatgataaaaagcattgaacagttcagtagttgccggtcgttagccttagcgagtctgagatggtgtgagcagacctaatccggtatcacgaatatcgactgtgagttgtatgggtgaaatcaagtaacccgtactggttaacacccactaacgtgtagtacatctttcatgatgtgcttaaggtcagtaatgtaaattgctgatgaataccggtggtaacccgcgctcgcgtccggcagacgacttcgtctgtcggacgtttttattttcatttattaataaatcattttaaaggatggtcatacatatgcattttacagtactcggcgcaggcgccatgggattacgttacggtgtgttattacaagaagcaggcaatcaagttgattttgtggatacttggcaagcaaatgttgatcaaattcatcgtcaaggtggcgtctacgtgtcgcgcgatcaccagaatcgacacttagttcccgtcaaagtctcaactcccgaagattatcacgatgatcccgacgtgtgggtcgtatttactaaacagatgcaacttgctgattttttgactcggacggcccacgcttttaatggtcgccagtacgtgctcacttgcatgaatgggatgggtcacgttgaaaaattattacactacttcaaacccgaaaaattattagctgggaccgcactagtcgctacggtcttaaacggccctggtgatgtcgacttcattggagctcgcggcgccggcaccatgaatctcgccaattatacggaacaccctgacgaaatgacccaccgaatcgtgacagaattagataaatgccaattccaccctaatttaacaacgaacttccgcggcaccttgctggctaaagtcgtcttcaactcagtggtcaacaccctctgtaccctctttgaaattacgatgggcgaattcgcggcctatccaggggctgatgagctgagtcgtcaattgatcgatgaagcctatgatgtctgtgagcgtgatggtgtcaccatgttgaatacccgcgcggaagagctcgcctctgtcaactacgtcagcaaagtggctaatcccctccactacccatcgatgtatcaagatatgtctcataatcggccaactgaggtcgactatatcaatggctacctcgtcaagctcggccaaaagtaccattaccaagcaaaaacgcacgcgtttctgacccatctggttcacttagccgaaaccacccgccaaaccagtgccacaactgaacacactactgaacaaaatgctcagaacgcgaccgaacaggctagtcaacaagcaagtgcgtaaccgattccccttttctcagcaaaatcatgtacaatggaggttaagttgattttactgaggaggcggtttgctgtgcaagtcagtcgggaattcaaaggtatctttcttgctagtatcagtgcgaccttctgggggatttccggagccgtcgcacaaacactttttgatacgaccgatattaattctatttggttaacgggaattcgcatgctgggtgccggaatcgcactattactggtcagtttgctgacccatgttgatttgtggtcgatttggcgtcaaccccgcgatctcctacagatcgtggcctacacactattgggtctaatgccggttcagttcacctactttttagcagttgaagctagtaacgcggcgaccggaacaattctacaattcatgggacccgtgttcattgctctgtggatgctagtcgctcatcggcaattgccgacccgtgcagaaggccttgcaattatttgtgcactactgggctcattcttgctcgtgactcacggcaaccctcagaccctagtcatctccgtctgggcgttgatctggggactcttatcgggggtctcgtccgctacgaataccttgctaccaaccaaactacttactaagtacgacccaatgaccgtcaacacctggtcaatgttgttagggggtatcttgtttaacatcgttcagccagtctggtcaatccatattccactgactatgcttaatatcagcaagttgacctttgttgtgctgtttggaacattgttagctttcctattcttcttgcaaagtttgcaatatatccggccaaccgttgtcagtctactagacgcttttgaacctttatccgcaaccatcattgcggtggttctactcggtgtcagcttcggttggctcgacattctgggcagtgtcctgattattagtaccgtctttattttggctattgggcagggtcccaatgatcgcacggcagagaatttcaagcaaccataaacgatgactcataattatgaaaccagtaaaagccggttgtgactaagtcctagtcacaaccggcttttacattgccgctaccgttacatatattcaattaataaccacgattcagatccacttggttacgtaccagcgtgccatctttgacaaactgtgcaaagttcgccgcaaagattggaaaaacggtcgcccgaaagtgggcaatttgacctgaaatatgtggcgtaatcagcacgtcatctcgttgccacaacgggtggtccgtcggtaatggctctggttcagtaacgtccaacgctgccatactgagttgatgatgatccagggcggtcattaacgctgtagtatcaaccgccggaccacgcccaatattaatcaacatcggttgctgtttggtctgctgaaataattcagtactaaacaaatgatgcgttgttggcgttaatggcaaagcgttgacaataaagttagccgttgctaacgcgtcagccgtcgcggtaaatgccactgtttcatgaaaatgatcagcggggtgaccggtcgtattgaccccaatcacgtgcatgcctaacgcactagccttagccgctaacgattgcccaatttggcccgtgccatatatcaacaactgttgcccggtcaaggtagatgtcgtcattggcaaggcccattgccgtgccccgcgctgattcagccaggccgcatggtacccccggactacgcttaacatcgcggctaagaccgattcactaatcgcatcggcgtgaataccactcgtgttcgcaaccaccaccccggccgcttgcaatgcctttaatggcaaataatcgacgccagctgaaatgacctgtacaaactttaactgattggttggccgcgctaggatcgtctttaataacggatgattaccatacatgacttcaatttggtcgtaatcggccgccgtgaccgccgccgcatccttgaacgtccagtccggataagtggtttgtaactgttgcagctgttcaggtttggttgcttgagccatcaataccattggcataacttattaccccatttctaatttcttgatcaatacttttatcataccactatcattcacttgaaccgtaatgatccacaaccggatattagctaagattggccagtaagttaggctgacccttttttagcccacagtttggtttaaatcacaatgtttgacgctactgctgacaaacggctcacaaaataccaacaaaaaagcgatgttcgaaagtcgcactcccgagcatcgccaatcggtaactaacctaattgggtttaatcgttgaccaattatttaacaaccgcaaagccaccggtccagccgatttgttcactggctgctaatgtcatttgcataaaccccatcgcttcaagctcacgggcccgctttaacttacctgcatccttcacttctaacggactttcagccaaggcgcgggtgaagcgttgcttggcgctatcgtcattaccagcaactaacacggttgttggttccttaccattgacctgcccactctgaagcgtcgccgcaaaagtcgtattgaaagccttgagcacctgactatctggtagttgctgctgtaattcttgggcagccgaactatcagctggaacaaccaagtcatcccacgtgtcaaaattcaaggggttcgtgatatcaacgacgattttgcccttcaactgagtcgcgtactgtttagccagcgcagctaaagcgggataaggtaccgccatgatcacgatttcaccgagcgttgtggcttggtccttggaaccataataagtgacctcgtgcccagcgatttcaaaattatgaccaattgcttgccccatgttgcccgtaccaaaaattgtgatttccatatcaaaacacgcctctttcgctttataattaattttatatttgcattctaacattgatgtcccatttacatcacttttatgtctgacagttaccgcaaaccggtcgtcaatcgccctagctagtagtcgctccttgaatgacgacaattagtggaactaatggctaatcagctcggatattcacctgcctgcacgcttcccaggttattgacacgagtcgatcagtcactaacgaccaaaaaccgaccaacttaattatgaattaattaagctggccggtttttaaattttcagtcgatcatcaagtttactggtctgttacccccaaaaattaattattgcccgttgccgtactataaccatctgtagaagaagcagtgccaccggtcgttgttgaagacgtatctccataattcgtcgttgagctactatcggtgtttgcactataactgtagctaggcgtacttgagcttgacgttgccgagctcgtgtccgtatcgttgctataactatgcgttgaagccgaactactgttgtcactactttcactataagtcgaatatgatgaactcgacgatgattctggttcactatagctatacgtgctcgaacttgaggttgaagacgatgcgttattcgctttcgccaacttcttgcgatccgtaatcaacttctggtaatcatcggccgctaactgcgactttttgcgataagctttcaggtttgcaagtactttatcgactgtcgttgacggggtcgaagccttgagtttatttttcttgttatataatttttgaaaatcagcatcatagctgaccactttcttaaccgtttttcccgttgtcgtaaacaacttgtcatacttcttagcaaagtacggcttactactcgttaagccagcagtcgtcaaccgctgctgacccttagtaatggtgtccatggtcacgtcggtcttaagtaaccccttagcgttgcgtaaatcttggtaactagtccggaccgtcaacatcttagcagccgtatcatgctgtttctgcaaacgagtcttttcacttgaatccttcatattatcaatattattttgcaacttggtcaaagtcgagcttgaggcactcgcccgcaagtcccgttgggctgatgatgtataaacttggtccacgatcttttccgcattggttcgtgccgcagcttgagtggcttgcccatggttccacatgaagaaagctccaccagcagcaacaaccagaatcgcaacaccagccaacatcaacttccagttatagcgccgagctggcttcttaagatgtggattcttttcatccgtttctaactcagaaaagtcacggtcgtcatccggctgatcatcatgtggtacccgctgttcttcgtgccgagcgacccgtgacatggttggcttattgggctgcttgccaccgttgggctgctgatcaccatacaactcttcacgtgataatggtaactcaggctgcgtgtcatcatccgcttgttccgtccccttgaccgcaatccgcggttgctgtttacgagcaaccggtggaatatgatcagctgggatgcgcctttcgaccttcggctgtttagcagcagtcgcttgcggatccttagcggttgtggccgtggcctgagatacagcagcccttgatgtcgctgacttgggggctgtggacttcggggccgtggattgtgctaccgcagatgcggcggccgcggcactcgatgtcgaagcactagactgttgactgtgcgtcttggcctgactagcacgccgggccatccgcgtcattggaacttccgacgttgccgccgactgatgaaccttggtacttgctgttgttttagccacacgcttctgatcagacactgcggtgctggttgcttgtgacgcttccttagcggcccgcgctggtgccgattgagccgcactagctgtcgtcgaagctgcgtgcttgaaacgctggtcacttactgcctgtgatgagaccgcgctggccgtctttggcgccgcctgacttgctgttgaggccggtttagttgcggcggactttttagttatttgcgcggattccgcctttgccgacgactgagaaccagccgagcctttttgcttaaccgcactagtcgccccatgcttgacgggtgccgtcgattgttttgcagcctggcgatcgtctccggaatggcgcgcttttttagccaccttttctggttcaattactgcgtcaacaggttgcttttcggcactgttattcgccgtcgagcggggaatattgaccgttgattttgcttcggcttcgtccgcctttgatgcggccgagtctttcagatcataggccaaggggatctgttcattatcttgttcagtactatcatcgtcgggaattggctcagtaatcgaattccagagccgtctacccaatccttcttttttattttttctagacaaaaccaacgctcctcgccaatttataatttacattagattcctggttaagcgccgaccaaaaatttttatcaatttcggtaaaataaccattaatagttaaattatagcatggaattggctactgagaaaccactggtcaagcggatttgtgaataactgcccaataccttaaattaaggttaaaactctgctataatcggcttatcaagatatttgaaagcgaggagttcatatggctactgcgaaagttatttttgctaccattaccggtaacaacgaagacgttgccgatattattactgaaaaattcgaaaaacttggggtcgatgttgccaaagaagaaatctcgcaagccgacgcaactgaattcaacgatgttgatatttgtgttgtcgtcccttacacctacgatgagggcgccctccctgaagagggactcgacttctacgaggacttacaggatttggatttaaccggtaagatttacggctgtgccggctctggcgatactttctatgatgatgattattgccgcgccgtcaccgatttcagtaacgcattgaagaaggctggggctactcagggtgccaaggacgtgttcgttaaccttgcaccagaagctgatgatgtaaaagccctggatgcatttactgaacaactcgttgctaaagttcagtaacctgactagtttgattgagtgaataacaaagaaacgcttcaagaattcatgactaattcttgaagcgtttcttttattaactgctatcgacacatcatcctgacgctgataccgaaaatcacaatcaccgtaatcacttttattcagtccttacgatttcgagcacgttgtttaatggcgtttcacacgccgaaatccgagccaactaccgaacatggtcaaccccaatagcactgttcccatcacatttgcacgacttggcgcttcaccagtttgcggtaaagccgatgtgccgagtttggccgttacaggctgaacagctaccgaagctgattcagtcggccgtgattcttgatgatgaccgccaacgatagtttgcgcgtgttgcagactagctgtgttggtcatctggctccgatgcgtccatgaagtgactactgatttagccccattagccgtcgtttgcatgccagaattacgatccgcaccctttccatgattcgtgccaaccgcgggtgttgcgtcatcaataactgcatttgcatcaacgtcagccgcatcaccctccatctggtcagcatcatccgtaggtatttctgcttgatcatcaccatcgatacttccagtcgagccgccgttcacatcgtcattggtattggtagcgcctggctgttcagtattcgtatcgccatcgctcgccgcaacgaccgtgactgttgccacgcgagtgaaaacttgaccactcgcatccgtatactgataagtcacctggtaaacaccggcttgattagtatcgaccgtgccagttacgactaggtcagcaagcgacaattcaccgccattaacatccgtagccaagactaaattatcgcttggttgccacgactcaccgacagtaatagttgaatcatgaatctgtaaatcgctttgggattccgcctgttcgtcggcctcctcgataaccaccgttaccgtcatcgttgccgtcaccaactgaccagtcttgtcagtaaattgatacgtcaaccgatagtccccggctgtagtccaatctggcgttccaacgacctcaatggccgaccagtctaacgtttgaccatcactatcagtggcattctgaaaattgctttggggctgccaagtactggttccctgcccatccgtatgcaccgttgcgtggttttgatataagttcaaactggcttggttttccttaacagttacagtaatcgtctgcgtctgactaccatacgtgtaagtaatctggtaatcacccgggaccatggtgttcacttcacccgtcaccgtcacatcgttaaagtcgatggcgtgaccgtcctgatccatcgccccgtcaaaaccgtcctgcgcatgccaagtgccaccagcgtgtagttccgtatcatggacagttaaacttgtctggtcagccttcacgatcaccaaagcagtgaccgtcttacccgcatacttgaaagtgacccggtaagtccccggctgactagtatttacccggtcacccgatagtttcacagcctggggattagcttcatagagggcctgaacatcgactttttgaccaaattggtcggttaaactctcgatactgtccgtccagttccaatcatcgccaacttccagggtaatgtcgttggcatcgataactgcttggtttgcttcccagatgtaggttccaatcggcatattttttcctgaatacagattcatcagttcagcactagttaaccgttgctggggattggctacatttatccagtaaccggtatattggtcattagcttcaatgtccattagcccaaccgactcgattttggctggcgtcaaatcagtatccggaccaagtgtaattttttgtagacgctcacatcccgcaaacatgtcgagattttgttcaacgcgatgcaaattaaaaccagatagatccacctcagttaaattggaacatcctgaaaatagcaaatgaatccaagtaacctgatctgttttgaactgagacccgaatttaacactggttaagttgtgcatgtccataaaccaagcagccatattgtcaaggctatcagtcttccatttggataagtctagctccgacaaccccgttttgataaacaaaccgcctgcttcttttaggctttcaaagttcaaattctcgataccaataatacgagttaacttttcattgggaccaaacatgtagtccgcttcacttactcgacgagtgtcccaccctgaaatattgattgtcgttagttggctagtccctggagaattgaaaaacaggtaagacatatcagtcacatttcccacctgccagctgctcaaatctagctccttaacatgcgtattttctgaaaagaaatatcttaaatccgtcgcagaactaacatcaattttttcaagcccttcatagtgttcaacattcgtcaaattttcaaagaagcccccactatcacctataatgcgaattggctttgaaatcacaactttaactatttgtaacacccacgattttgattgccacggactatccccatagcaatcgtaaatttcgccaccgtccaacactaatacaccagaatccgcgtcaaaatgccatctaatgccatcggcgttgtacccagcaccccagatgccggccatcgagtcgtcgtcttccatatcatcgttgcgataaccatccgtgagatgtgggcgttctggatttcgaatcacgccagccaaatcaccgcttccccgctcattgatggtttccgttttatgctgcaacgacaagacttttgcagtactatccgtgtcaatatcttgcgactgctcgtcggcactaactggctgttcagaattatcagttgtcgattggttcggatgcgtatcaagtgttgcagtatgttcgtctgacggaacgggggtctcactgtcaacttgatccgtgaccggtacactgacctgatcagaattcgcatgctcatcatcagattgattgacaatctcatcagtatactgttcttcagcggcctgcactttaattggttgagcttcagttaccagttcactcattgcggattcatccatggcgtccgttactggggattgctgctcagcgttaccttcagacaaagttgccactgccggttcagtcaatgcttctacgtgtgttgcttcatctgctcgtcccgtcaccacattcatgttcaacgtaacgagcgtgattccagcgaacaaccacaccttaccactcttgtacatcttgtaccgtttcttcacttgttccattaatttctcactcctttattaattaaccttgccgacgtttaatgccgacgatgctggctaaaccagtcaccattaacatcatgagtcccagcaacccgaagcgattaacttgttcgctagtttgcggtagctcaccagctactgacgctggatggctgactggggccatagtcacttccggtttagctgtatcagccttagcataacgtttagcatcaattccgtcctcattgcgttcagccgtattcagtttcaagttatcacgaaacaccgtggtcacttgcttctctaaaccaccgttaaattctggtcgcactatcgtgtctgcttgctccctttgactgctggaaccagcgtttgcgcccgttaaaccactgttaggatcactagtatcagggtgttcagtagttcccggttgttctgattgttcaggaacttccggcagttctggttgatcaggtgtccctggcgctgacggttcccctggtgtttcgggggtttcaggggtttcaggctgttcgggtgttcctggttcttccggtaactccggttcagctggttctcccggtaacggcgtttcaccattgccagcaccttcgactaccgtaatggtggctgtttgagtccactgcaggccattggcgttcgtgtattgatacgtgatttcataagtaccgggttgcgtcgtgtcaacgtcaccaatcacaactaagtccgctagtgttaatggccgtcccgtcgcatcactggcacttacgaagttgtctgccgcctgccagtggtcgccaactgtcaccgttgtatcttgaacaaccagttctgtcaggtcttcaacgtcagcctcttgttcagtcaccgtgacggtcgttgtcgccgtgactaactgtccggtcaagtcagtgaactgataaacgacctcatatgtccccggccgtgttaagtctggttctccaagcaccgtcacgttctgccattccactgaacggccatctgcatccgttgcactcgcaaaattatcccgtgggcgccagacagcgcttcccgttgcgggatcaatttcaaccgcaacttcttgcgcatgtagttgactttgattagccacaaccgtgacaaccacgtttgtttgccgacccgcataagttagtatcacgtgatacgaccctggccggctggtgtcaacaggctcaccgctaactgtcaccgcttgggggtctgtactgaacaagactcctggatcaactaactggccattttgatcaactagttgcgcaatattttgtgtccagtcccatttttgattcaagaagagcgtgctgtctttaccggtaatcgtggccgcagagacggtttcccagacaaacgtcgccgtgtcagcgtggtttcccgaatattgcgccaggagttcagcactcgtaaacgtttgcgagctatcagctacgttgacccatttgccggtatgtttgctattcttaggcacttccggtaaatcaactaagggttgcgtgccgtgttgactaaaatcaagtcccggaccaagtgtcaacgtttgcaaacttgtcaaaccagctagcatttgccagttttgttcaacactctgcatattgaaatgggacaagtcgagcacctttagtttggcatcatcattaaacaaactattgatttgagtgactttagcgacggtaaactgcgtaccgaattcgatacgctccaaatcggacatctgcgcaaaggcaccatcgatttcaaccaggctggctgaatcaaagctcgtcagattcaagtgacggacgcctgtgcgcgcaaacatgttagccatcgtcgtcacactgcgcgtatcccagtcagtcaaaccgtcaatagttcgaagttggccgttgaactggaacatattttgcatgttggcgacattatgagtatcccagccactgagattaaggtatttaagttcagtacccatgaagttccccataaacatgttcaccattgtggtcacattgccgacttgccaagcactcaagtccagtcgctctagcgaggtattttctttgaacagagactgcatgttggtcacagcactggtatcaatcttttctaacccttcgtaacgcgtcacgctgtcaagattcgcaaacagactattcatgttagtaccggcaacaattttgtcagcaatcacgatacacttgatcatcggcgcccaagacttgcgacgccaaggattatccccataactgttatttaacgttcccccgttcagcgttagcgtgcctgtactggcatcaaagtgccaatcaacgccaaagttaccagacatttcatcctcatccgccctagtcacagcacgagtatcaacgtgctgtgactccaccttaaggtcatctaccagctgatgctgctcaacatgttgcaagtcagcggcgggtttacgttctgacgcgtcagcagtatcgagtaataactgttcactcgcttcaggctgttgttcactaacagtcgattctgcggcattactgaacagatcgtcagtccgtgatgcttcataactgttcgtcgcgggcgctaccgtgtttagtccgttcactgctgccatcgaatcagcggctacctcactattgggcgcgccagatgtcccgttcaacgcagccgttgatgcagcggattgcggctcgtcattagtagctggctgtgcatcgattaccgtctgattagtaatcgaagcgttctcatcattagccacgacaacgttatccgttttagaaaccgaacttgccagtgtttgattgctgctaccttgattttgaattgacacaccgttagtcgctacgacactcgtttcgctagtcgatgcagatgttggttcatccgcatgtgcggttaacagttgagtattcaacaataatagtgaagcgctcgcaaacaaccacatcttgccacttttatacattttataacatttcacttctgattcacggtaattgatagtaattccccatttcttcaaaaacaacctaactgacctaacgattaatctcattaaataaagtgttcttactatatttgattatcgtgtttaactagtacatcatttacggtttttaaatataccatggtaccctcataatgctcaactgattatcacaattctaattaacctgttatcattatgattaatccgcttgtttatcgcaaaaatataattatcaactccctatttctgcaatcgttttcatcgtggtgattcattaattctggtcgttttagtattcgaccaccactattcgttcaccatactgacagttgcatcatgcaccggtcagctgtcaccatggcgactgaccagtggcttccagtaatccccggccatcaaaaaagccttgagcaatattactgctcaagacctgatttacccattctaatagcgtatttccctaatttgaatcgaaagactccccccgcgtaatcatgagctagtagatacgataattgtcactcggccccgagtcatttggatcgtcgtttcacaacgatttgtcgaatcgcattataaactagctcaacgatgacaaacagcaccgtgatacccacaatatcaattaaatacgaactaagtcgatagcccaccttgccgatccacaaatcatacggcccttgaatcagtaagaaatagatgactaacgtttcaaaaatcgtccgggtatgccgccaaaacgatcgccattgcattgatttcacgccccttcaagtggtgccaacatttgtaacgcctgtttgacctgactcactgctaattgactttgatcaccgacccggccgacgtgtccaaaggcaactgccgaccccgtcaactgactacagacactgttataacgaccaaacttgcccgtcgccgttgccacgattggcacaactaattgctgccgtgcttgctcagttgccgccattaatgccaacaccgtctgtgcatcatgtccagccactgtcacccgcacgacatcagcaccagttgctgctaattcgtgataagtcgccaataaatcgtcagttgttgctgtcgtgacggtctggctcgcaattaaccgaatttcgttggcacgcatctgtttggtcaacgtcataaaatctggctgattgaccatggctaagtcaatatccacgccagccacgcttcgattattcactaatgtttgataagtttgataatattcggtcacttcagctggatcgtttgccagcccaaacatggcaattaatggaatcgtccccaaaacttgttgcaattgggccgctgtattgactaactccgcacggttatccaattcctgataaggatctaaccgccaaacaacaatttgtgccaccgaagttaaaatctgccccgctttacgcaagaggtcctcccgtgtggcccccgctaaaacaacaccaatcttaggcatccctgtcgctaacgttaactccccaactgtaacttctttcaagaccattcctgctttcattttcattcgaacaatgcgcgtccgttgccgttaaattttatctactcttaacaatagcaaattttcgctgttttgacactcaaaattcattttttgacttaaaatttaaagcgcttttaatattaacttgttaatactggcatcgctttcagtttggccttacaattaagcatactttagctcacaaaggagttcaacatggaaaacgaaaaacaacttcgatggtccaacattgctttaattgcattcgtggcggtctggggcctaggtaacgttgtcaataattttgcgttacaagggctttcagtcgtcacttcttggattttgatcatgattatttattttattccctacaccttgattgtgggtcaactgggttcgacctttaaggatgctgaggggggcgtctcatcttggattcgagcaacgagtaccaagcgcctagcttactatgctgcctggacttattggatcgtgcacattccgtacttagcacaaaaaccccaagggattctaattgcattcagctggctgttccgcggtaatgggaacttcgtcaacacgacacctgcgttagtcgttcaagccatttgtttagtgctattcttattcttcctctggattgcttcattgggactaacgacactgaaacgcatcgggagcgttgctggtacggggatgttcatcatgtcgattttattcatcatcttggccgtatcagcaccgtttatgaccaaggcgactgttcagacaccgaacatgttttcactcaagtcctacttacctaagtttgactttacctactttacgaccgtttcaatgttagtcttcgcggtcgggggatctgaaaagatttcgccgtacgttaataaaaccaaaaatccgggacgtgagtttccgttaggcatgttagtgctcgcaggtatggtcgcaatctgtgccctgctgggttcatttgccatggggattctgtttaactccaagcacattcccgctgatttgatggccaacggtgcttactacgcgtttcaacgactaggtgccttctaccacgtgggcaatctgttcttgatcctctacgcaattgccaatgtgcttgcccaaatctccgccttagcgttctcaatcgatgcgccattgaagattttgcttggtgatgccgaccctgaatttattcccaaaaaattaagtaaaatgaacaagaaggatgtgcccgtcaacggttacatcttaactggggttttggtcagcattctcattatcattcctgcattagggattggaaacatgaatgaactatttaattggttattgaacttaaattcggtcgtaatgccgatgcgctacctgtgggtctttctagcttacatgctactcaacaagcacttaaaggaattcaagagtgattacaagttcctgaaaaacccagtcgctggccgtttggtcggtgcttggtgcttcctgtttacagcatttgcttgcatcctcggaatggttccaaagacttcctacgctagcaatcctagcagttggctcttccaactgactttaaatattctaacgccaattatctttgttgccttagggatgattttgccgatgattgctcgtcgtcatcgcactaaaaccgcttagtgcgtcaccgatctttacgcccgcatcgtcgctctacgcctgcggactcactgacttttttgtaacgttgatcgataatctattcgccaccgctgacagcgcaaaaaactgtcagcggtggttttggtattaccaaccgttgctagtaggcatgcgtgttcacgtaacatttcagtcactaatttgcggctcacaatcttacactttttacacgtttagcggtatgattcttagtgaatatagtcaatccaaatttaccaagcagtcgctcttcaaggaggttcttattatggctaccgtcgacgctctcgacatgtttttgaccgattatgccaatatctctcgttacctgaatactcgcttaaattcactactggccacgcaacatcttacctttgacgcttttttaatcatgcatgaaataggtcaaagcccccagccactattattaatggagatcgcacatcagcaccatgtctcacgcagcgcaatctcacgccaaatcggagtcctcctcaaacatcgatacattgagcaacaggctaatgccactgatcgccgccaaaaaggactttccttaacggctaccggccgtcacctagatcagcaactaatggccaccatgcacaaaacggttcaccagtggacgactcaattgggcccgcaacgggtgaagaccctgctaggcatcttcactgactttaacgagcaaattatcaataatgaggttcccgccagcgattaataaccagccatcctcagcttcatcattcggcattagtcgtaacgtgccccattttagtaagctgatttttattcgtcgccatttcaagttacggcttttaaaggccttaatcaaaaaacggcgccatggatgctagtgattctagcgtccatggcgtcgttaattttcagttacaatcaaagcagcttacactacggtacgttcgtccgcgacttggccggctctgccgctagtcatctgcatgcacgtcaaaggcatgcaacaactgttctgaaacccctggcgcatctgggtcgtggtgacctttaccggtatctaaagctcgtaattgggccatctcagtcgaagttaattcaaagtcgaagatatcccgattactcttgatccgtgcactgtgcactgatttaggaaagacgatcacgccttcttgatgttcaaatctaagaatgatttgaccagcatccttatgatacttaatagccaattgttgaatgattggttctttgaataatgcttgattgccctgacccaagggcgcccaagcttctaatttaacatcttgtgccgcgagtaattggcgcaagggttgttgctgaaagtacgggttaaattcaacctgattgactgcagggatcgtttcaaattgtggcacaaatttttgccacaacgttggtgtcatattggaaacaccgatcgactttaatttcccggccttttgggctgcttccattgcttgccatgcacccggaacatcgccataaggttgatgaattaagtacaagtcaatatagtctagtcgcaacttagttaacgaacgatcgatggcgcgactggctgcgtcaaagccgtagtcttggagccaaagtttactcgtcacccagatttggtcccgtggaatcccactatccttaatagcttgaccaacttcgtcttcgttaaaataggccacggctgtgtcaatgtgtcgataaccaatcgccaatgcttctttgactgcttgataagtggaaccgtcgtctggaatctggaaagtgccaaacccaattgctggaatcgcgcggccatcatttagcgtaatagttggtgtttttgtcattaataatcactccttaacttattcatgtaattgtcgtaaactagcgccaaaaatctgttcaattgtcacaggatcacgatgatcaaagaactgactgacgccctgatcaagttcggccattgctgacatttctgcagctgttaattcaaaatcaaaaacagcgatattctcagccatacgttcaggatgcactgattttggaatcaccgtaatcccgcgttgcaacagccaacgtaagatgacttgtccggtcgtcttaccatgggcctgtgcgatagtttgaatacttggattactgaaaatcgcatgcttaccttctgcaaacggtgcccaagcttcaacccgtacgtgttcatcttgattaaagcggacctcgtctgcttgctggtaccatggattgacctcgatttgattgacagctggttgcacggacatggtcagttccaagttctttagctgatccgcataaaaattggaaacaccaattgcgcgaatcttaccagcatggtaagcctcttctaaagcacgccaagcacccatcacatcgccataaggttggtgcaaaagatacaagtccaagtagtctacgcctaaacgttgtaatgacgcatcaataccttgctttgcacgttcataggtgaattctgagacccacagcttggaagtgacaaagagttcatcacgtctaagaccactcttttgaattgcccgccccactgcggtttcattttggtatgccgttgccgtatcaattaaacggtaaccagcctttaaggccgcggtcaccgctgcttcacattcattcaggtcagggacttggaacacgccgaatcccaattggggcataaccacaccattgtttaatttcgttgttggaaccatcacgcatcaacctttcactatttgattacaataacaagcatacccgcaaacctaatacttgaaaattactacttattcatactagtatacatatagtgcatactagtaacggaggttcctgatgattgaaaattatttattagaagagctgatcacattcgcccacgagcacacgctggctaagaccgcggccgcattaaacgtgacgcaaccaactatcactcgcggcatgcagaaattggaaacaatgctcgctgttcgcttatttgatcgtcaacccaatcgaattacactgacgcccactggccagttagccgctcaggaagctgaacaattattgacacaacaacggacttttgtaaccaaaatacaaaactacgagcaaagcttagtcacacgtaccgtcgaaaccaccctacctggtccacttgccttactcacccatctcaaaacggtattacctaattcgctgcgagtaaggcaaccactgattgccgacgaccaaatcactgagcatctcattaaccgccaggcaagtttcattttctctaatcaggaaattctgacggccggcattgaatctcgcttcatcggtactgaaaatctcgtggtccatttacagcgattcatgtaccgtgcgaaccaacctagcatcacgttcgccgaacttaagggaattagcttcgtggttctaagcgcaatcggtatttggaaagatattattcagcaggccatcccagatgctaaattcttataccaaccccaacgcacggcctttacagaaatcactaaatactctgattttccgtacttcagtactaactttaccgcattggcgcctcaccagctggatagccaagccgatgatgacaatcgagtcgctatcccgattagcgatactcgtgctcacatgccaatctatgtcaattatcttgttagcaatcgacaatcattaatgcccctattcaagcaatttgaagccgcgtggccagccaatctcaagcatacttccacgtcctagcagctaacataattaagccgttcggtctaaaactgcaaaatgaagtgttacgctcaatcacagggggtatatactggttgaagttcgccctcccagttcttgatagcaaaagaggtccacacgctcgcttagctaatctaatgcgagcgtgtggacctcttttcatattaagtttggttcgttcaagtcttaatcttaaacatggaccctaatgtgatgattagttgcagaaaaaacagttaaacaagcattccacgccaatcatcttctaacagcaagccgtttagcagatttgaactgccgacctcttccttaccatggaagtgctctacctgctgagctaaaacggcgttaattgaccctatccagtataccaaaagcatgtttaaattcaaactgtactggttgacattcaacgtaaaaaaaaggaacaagttcgcttgattagttcgataaaggtagtcaatatcagggtttgcgattgcttctaacaccttatctcgctgaacattcataccgcctttaaaagctgagagtttgatgtaagttccattaccactatttggcacattctttaatacaaatgtattgattggaacggtggcttcctcaaatgctgagtactccatttgaatcaggctagaaatctccttgttggccactaaataactacgcagtttctcatatgtcttaataaacatccaaacaaatggcgtcatataggcagcataaccgccaattttaactaaattgatattgttgaatataaagacagagaagagatcccctgagtaatcagcatagtttttcttcacatattttttcatgtctggatcgaacttgttcaagtacggtggatttgttacggccacatcatatttagtagacataatttcgccgatggttaatacttttaatacgatctttttcgattgattcataccaaagatatccaacgcgtccgtgtgcatatcttccacgttttctcgcaactttgtccaattaaacgttttgtcaaacttgataattgaacctagttctctggcgttactaaagagctcaataatttgttttatatcatctgcatattcacccgataaggcatccaaaaactcaggtgagaccgtgtccgtatcttcaaaaacgtggacatttagtttaactttttcaggctgcaaggcacgccgattgtattgtcgtgctttcatcattaaagcaaaatatgccaactgataggcacgtttatcaatttccaaaccgtataagttgttttgtacgatggataaggctgcaccacgacttgagtatccctgttccgcatacattttcataaagacatcgaacgcatataccagaatgtggcctgaccccatcgcattgtcgataagacgcatatcttcgagattctcactagaatcaactgtctgaatctctccaggaagcaaataatccaaatttgatttcaaatcactgttaggatgacgttcaagccagtactttcctaatgagttatcaaccatataacgaacgatccaatctgtggtaaataactgagttgcggcaggaatttcgtttttggtaacggctcccccagtgatattcactgcataatcatgtggttcagtattatagtactgatacagccatccaataatttcaacctgaccaccacgagtaacgtcaaaatcgacctcatcaatatcgttaattagatgctgaataacgccgtcatgatagtttggagtgaacaataattctgcataatcgttagttttttcgaataaatgtggtaggtttgcatttaaagcgttggcttgcttaataaatagcatccgatatttggcgtccatgtcaactgtggcttcagtttccgaagcatgtaccataattgcttgctcctcgttgctaaaagcaccaagatacggcactaaatcggcttcgcttcgcaacataatatctggttcattgcgacctgatgaactagacaatactcggatccgactcggcaaataaccattaacttccataaaccgaatcgcaattaggcgattgaaccaagtatacgcaacctcttcgactaactcattgtaggccgtctcataatcggttgccttctcacgctcatgtaattctacaactagtttttggcgcttaacaatgtttgaaccagtgattgggttgcggtcatccacataatactcaatttcagacgtagacgtttccaacttgtcggaaatttgttcctcagtaattcccaacactttcatttgtaatttgatagccgcaattagtttccgtcgcgattcaattgcaaaatttttaatggctgttttgtccatttgtaattcctttcaacttgactattaaagatcaatcttcaattcatcaacattatccaactgagcaattaatacttttcgtaattgtgccaattgctcgtcaacatctttggcactagttacctgccatgaacggttaactggcaaatttttaaggctaacatgcttcgttgtcggtactagaggcgttaccgttgttgaagtgaccgttggagtttgatcctcatttgtatttgtttcatctttatccacttgtttctgtgcacgttgtaatgcagcttgttttctctcaatttcaacgatttcttcatcaatgcgcgtctgtaaattatccttcttaacggaagccttagatttaattacgaccaattcatccaaattacgagctgcttgtgcttcttgaataaattgttcgaaagcttgattgatggtcgtttcaaactgaccaattaagccattattctttgcgtaattcaaagctgcttgccattcaatattgacattcgctttaatatccgcttcagttttatcaaactcttcactatacgcgctattaaattcttcattaagactgttcaattcatttaaccgatcagccttgtttgcatcaattcgggctttaatttgcttatagatcttaccaacctcagccccactaataaatgaactagacttctcatagatatcaatcttagaaagtgcatctttccagatcttctcttgagtcggattattgtaaaaatcgatcaacccatagtcatacatatcatcggaccaatctaagaagtcatcttgatgcttaaataatttatcgtaaaattggtccgtatcagtctggctaattaagctattcatcagttgtaaaccattctctaaaacgtttcttcccggataacgcgtagatagccgcacgaactcattaagtgcatctcgctctttaatcatactttgacgtaaattgttaactaacgtatcatcttcatcgtcatcaaagctctgccggttgaagacgtccttagccaccgcttttaacgcttggcgtttttcttccgaaacggcgacacgtggaacaaattgcatcttatcaacatactgtttcttcacaaaatagtttgctagttcaactggcttagtggtatcttccatgttgattagtgcattgttaacatataccttaatccgattatcagcaaaaagtttggccaccatccacttaatgtcgatatcacggtatccatatggctctactccaaaacgatccagaatcgacttataagccactttaccgtgagaaccgttatcagcatcctgaacaattcgattcatgacagcttccaccgcttgtttattttcatcaggagtaattaactcttgattgaatagtgcaacaatatctttctccgacttaaccgccgtgatatagcttaagttacggtaaatttcgtcaactagatgttcctgtgccgtatttaaacgttgtccaaaactcttgcttcctgcttctagcagttcaccgccgacataaatatcagcatcttccagtgcatcttccaaatccacatgaactttttcaatcaggcttactcgctcagcacgcttaacatcaataatattgttagatcgagcatcctttgcgtaagcacctggatccattacaaatttttgaattttcaatgcttgtgataaattatgggtgtaatcatcacgtctaggcatatcaataataatttgtggttcactaggggataacgcgattcgtcttaattcagtttcatcacgattagtattactttcaggagtgttcagttttaggcttaacgtattgttggccaaccccaatggctgatcatcaacgaactgattgaaattaaacgtatactgcttgtttagcttgggataagtaaatttccgctcaatttttttcgcaccgaataggtaattcccgatttcacgagagacttctcctggctccacatcctgttttgaaattgatcgactaatctcctgctcagcgttagttaaaaactcaaaccctttagtcgtctcttcaatgaagttttgattcgttaactcagtcaaggcttctttaacccgtttttccaattcaacccggtcggtatcaattgaatcaatcatcaacgtgacaacgttattcagagtagcattaaaattatctacatacttcaccatgaacagtgtttccaaaacctgcacggcaaatgggtgttcaacaccatctggattaacacgttcattcttaatcgcacgttgaatcacaatcatgtgcgtgtggtccaagaattgatctaggccctggaagaaaatactaaacggaactaacgcccgcacgtcttcattttcaatccgttgtgctgattcttgaaaaactgctagcattgaacgttcaccgtttgctaagtgcttaccgtcagaaccgttttcccgaatggcagtcaacgtatcttgtaataaattatactgatacggtacaaatggataaacatctgcaaagttttctgcactttggtaatggtctcgcgtaatatccgactcaaatgtcatcaagttgttgatggcatgttgatcatctgaatacgtccgcatcagggcccgttcactttccggcgtcttgactaataatcgcttattaattacttcatcaacgttcgctgacgacattgcgattcgagtattaaaacgaccctgaattttcgagaaatcttgtccattaatatggtccgttacttgatcaattgcttgttgactagtcacaattacccaggctttcccatgggtatatgttcccaaatcttcaacaacactttgtaaattcaacattcgttgctgactgtcaccaatatattgaccaatctcatcgactaaaaacacaagatgataatctggatctgcttgtttctcaatatattcattaacccgttgggcaaaatcctctacactgagtgggtattccgttttaagctgctcgataaagccatcagcattttcttcagtcatttcgccgacagctacgagtgcttctttgattgtatttttaaaaaatgcgaacccatttcgagccttttgccaagttctacctttatcatctaattcttggaacttagcttgaaacgcctcatacttgtcatcattaatcaaattgcgttccatgtcggcaatccaaaagtcaacgcctatcaaaccaattttttcattaaaaacttgccagaaaacatttaaaatagcatctttttgtgatttgctgccattcttagcttttgaatcaatattaaatagtatcgtttcattatgtactgaagttgccaattgaatcgcatcaacagtctcttggcttctgatcttattatcatctaaaaaatagtcaattgctggcttgccggcaacattccggttttccaacatataagctaaaatctttaaaaagtgagatttccctgaaccaaagaagcctgaaatccagactcccatctccgaagtatcatgattaatactggcaacgtatgctttaaaaaaatcatggaaatgtttttgtaattcgtgtgtgacaacatattcttctagttcctgttttacattagcatcttgttcatcaccaatggtaataacacctttaatattacgatcaattggcttagcgaatatatctttaatcttcattattttgccccctcaaggccttgaaaaagtaattctaatttatttgaaaagcacgataatagttatcttccttagtttccccgaacatactaagacttaaactattatattcacctgggtagaataaaataacgggtaccgatgatataatttggtgcatcgtattcagtattttatgtgcccgaattaatggaaaaatttcaccaattccggttaaaaaaatcaccgagttttggctttctaaatgtttttccatatacttaacaaaaagattttctgaatctgtcatcttgagtacattatttaactgctcagtcaggtactcaatgccttcattttcctccatgtcaaaaacattctgtctaataccaatttcatccagtaatttccacataatttgatatacattgaactcaacaatatcaacaccaactgaggcttgattaaatctacgttccattttatcaatagcctcccgaacgattggcttgtcctgtggtgcatagcctagaatataatacgaaacttcgttagacagtccccgactttcttgaaaatcctgattcataatttttttctgtaaatgcgctaacttcgtacttgtgctaacgatcatactcacctccctaaaagcacagctaaattgcgatgagcgtgcttagcttgtaacaaatcttctaatctcaaatctagcatcggccgattaacttcgtcataatcgccacgatccttgagcaactctgcttcgcgacaaaatgttttaaaaattcccgctaatcgttcaacagtctcctctgtccagtctgcaatttgcgcattttcaacccgtttccggttaaaaaaatcctcaatctcataatcatgtaaacgcgcatcgcctaatagcaattcaccacgataaacctcatacataaattcgttaaaaaggcgattcatgttcataattgaaataagattaaccaatttttgattaccgatatctaaacttggaaataaaacaaaataatcctggtctaaagtaaccaaacgtttctttagtaccttcaagagatcttgagttcgcgcagccgtcttctgtttaaaataattatcttcttctgctttagctctaatatcatcttcactgtagccagcattaagtaattcaatatatgcttgaaattcagcaaaccaaaaagaatgtgaaaccattgttgcactatattttggcattcaattccactcccaattatcaaccattgatttgtcaacaatattcccaactatataaaagtatatcatatgcatagctaataaaaattaggagttcgacgattcccaaaaggattcatcaagctcccaatctttaatgtaattgacttttatggtctagagatactactcaacttaaacaactcggctcaagatatttccactacgtatctgataaatatgttcgtagcaagtatgcgggataacagctccagccaaaacaataactatttagtaatatcgatccatatggtgaataattggcatcagtttgatcaaagacttcccaaaaagtatccgcaccgttagccaccattgcaccccaatactgccgaattatatcaattgccactttagtctgaccattttgcaacaacacttcagccaacaacgcttccgtacttggtgtaactgcggtattggtgaagtcaaaatcatgcaatagctgttgcaacgcacgttgttgctcattcgatggtaatacattggctagtagcagctgaatctgagccagtaaatttacttcctggttcggcccactaataaatacagctttatcactatcatagaattctttaattgtcgcaattttcaaatcttctatccaagcttgtatttcattaacgtccgggtccttccactgtaatgcgagtttcaaaaaagctttcatcgcctggaccaaaataccttgaactgcggcctccttgttacaattggttgaccaatcaacaaaaacatcggcacgttgtcccaccgttaatcctgtggttaattgcactttaataaattcgaatgaccgcttaactaccggatataaatcatttaatactactcgatccctggtagcgtcaatatattctgctacggccataatgaactgcagttgataatcaaaccaatacaagtcatccgcaactggtattttagttcgtgttaggatgtctgctggcaaacggccctcttgatctgaaaacgccccaaataaatacaaacatcttcttgccaggttcatgtgcttaaaagtaacgtaatcaactttggcctgcattcgaaaatctaacaaccacaaacgacgatctctttttgtgccatcctcaaaaactgtctgcatagtatttcgcaaagtctctaaacaaacctggtcaattttatacagttccggcgggtcattgctgaatggctgtacagcttgtttcaataccgcactagccgctcgaaactccgcatccgccaacaccggctgccactttagcgactgacccaccggttccaacatgatgtagcgacagctatagcggcgttcgaactggaccgtggtcggcaataattcaacatggcgcgtgtcgtcttgaatccaggctgtgggcaaccaactggtcacgcgactagcatcgacacttaactcttgcaactgctcggcaaaccttgtccgcatcagtaacggcgcgtccattggcgaaccggccacgtcgatggcaacttgaaaatggccgacgtatagcgctcccaaatcataaatcaaacgttcatgcttatgtagcgcaattgcaccggtgactggttgccacgtagctgtcgctaaggtagcctgattgatcttggtgaccaccaagtaacgttgtggctgaatggtacgggtagttagtggtactgatatatttgcctttgtcagtaatttaggattggcagtaaaacattggtcagtaagcttatgaaacttgtgatcatcttcattactaaaagtaactgtcattttttaaccccatctctatccgtctaagttgctaccgataccatcttccaaaatctaatcatgaacaagtaccgcgacctttcactcgtcagcttcacgttcgtattaagccgcttctggctcccagcgttcaaaagcgccaatcagattctcagtcatctgtaactcgcccatcacgttgactagtgccgactgggcattcataaagagtgttgagtgcacaaaccgttgagccttggcattctcgatcagtcggcgtacctgtaaccgctgggccgtcagcaattcagtttcggcctgacgtaatttttcacgcgccgcctcgtagcgataggccgcaatctcagctaaggcagccgcaatcattgaccgggcgctgccgattttcaaaatcatcgtcatcgtaaggttgagcgtgtgttccgtatttttctgcatgtctgcaccttttttctttagatttcctactctttgaccaatcgtacacacttgtgttgacggtaatcttcatcatcgcgccattcccccaaatgacagcaatcatgatcgacaatcagctttaaaatgtcgtgccgttcacatgaatgcgtcggccgttaaatgtcttgacaccgttaacttatgtcatagtatagcattattttcagaaaacaattccgactttttcaatatatacataaactttacaaaatgaaaaccggggcaatttacgtgcatttgtcccggtttttatattaatattatattttcacagtgattaatttatccctgcttgcactaccgatcatgacacccttaattaatctaatgagtcagcggccggactggtctttgattcatccccatattgccagtcacgcatttgatttgccgcggctgctgaaggataggcgttattatcgaaccaggccccagcaccactagcattcattaaaactggaatttggcggccatcaaaataatgataacgcacgtattcaaagttaccggccccagcagtctgctcggcccccataatatgaatccatttttgtccctcagctgccgcataagatagcttcaacccgtcggtatcattttgcgtcatcgaattaatcttgtgatcgtacttattatagtaataccaagtcccctgataaccttgaggccattgattagccttcgcatcacgactcatgttcacgttcagtgcactatctgtcagcgtcgtcggtcgactgcccgtaatgatcttggcaaagccggcttgcaaagcactgttctgcgtgtcatgaatgatcaactcgtccccgttggtcgtctgagtcacaaagacgactgggcgctgatgatggaggcaaaagaagtacgtgtttggatattgtgcttccgccttaccacccgttgcgacagccaccacttgaaattcactacggtcttcgccgtccttggaccacttgagatccactgactgcgagccccacttgattcggcctgctaagctaccattaagcaaagcattgggaaaacgaaagcctaaatgatccgggaccttgtcatcatacgtcccgacataggtctggcccatctcgcgttgccacgaggccataaatgtcgataaggctgcttgcttgcccgtattccacaacgtagtcttaaccggtgatgaagaatcactgctagcggtacttttttggctagcagcctgctttgccgctaccttggttgacgttgctttttgttgactcgtcttggacgctgacgacttgggcgacggcgcgcatcccgctaataataaacttcctaataataattcgacccacacctttttcatgttgctcctcaccggtcccgtaccggtatccccctattcaataattacttttatggtaccaaaaaaagtcggcattgtgctgggcgttacaatataaatcttcacccatctcacttaccgactatggctatttacttaatcgtgatatttaacgtccctaaatgtgtaatctgaccgcacagttgatcgccggcttgcaaaaagacttggggattgcgaccaacgccggttccactaggcgtcccggtaaaaatcaaatcacctggttgtaactcacagaccgtcgacaagtagtgcaccaaatccggtaccttgaagatcagttggctcaacgacgcttgctgcatcgtctgaccattgacggtggtcgtgatcacctcatcgtctaagtcagctaattcatcgacggtcgttaaccacggcccaactggtgcgtaattttcaaacgatttacccattgaaaactggggattatcattctcgaactgaacggctcgatcagataagtcttcaccaaccatcactccggccacgtgcgccattgcatcagccgtcgcaatatcgcgcccacccttgccaatcatcacgactagctcggtttcccagtcggtctcagggccatgcgtcgccacggtcacgttcgctggtgccagtgaactactaaacttcgtaaaaatacttggaaccttcggcagcgtaatgtggatctccgccgaatggtcgcggtagttcatccccaccgcaaaaatctgttgcggggccgtgattggtgccgctaattcttgcggcgcaaacgtttcaagcgagccaagtttccggtccgctgctggcatatgtagcgcttccaaaactgtcttcgcatttaaaactatttgtccatgctgttcatccgtaatgataaacggtcggttggcccgcatgccaattttcatattaatcacctcattgatattattgtacactcatctcatgaatcataacaataatgatagttgcgtgacggtcattccggacaatcttcatgaacattcaaacgcaattacgaacttagctcaggatatttcttcatgtaacgctcatcactaaaaaaggtacccgcctaatttgcgagtacctttaaccattacggctgccattaatgtgggccgtcatcctttggttctgggtgtttcttttctggtgctttttcttgcttgtcattttgttgccgccactcttctgtcgttaacatgtctttaacgactaattttaacttagtcacttgataaccagtcattgatttaacggccttggcaaccttatccgccacccgtgctagaatctcctgaccattcttaccataagctagaatggccgtcaattcaattccaaccgtctggtcatcgtcatcggtatccactgaaacgccggtctgcgggcgatccttatccgtaaagcgattggaaatatcatcaatcagatttccctgtaagctcaataccccttcaacttcttgggccgtgttactagcaatctttgccaataccgtatcgtcaaaaacaacttctggttttaaagatgtcgctgttgcttccatcaaaattcctccttgttttgtcaaaaatcgtcttaccaatgactactctaaacgaccgtgctattcaacttgccgcttatctgttgattgatccgtatttggtttgccagtggcctgatcttgccaatcacgtttactcatgacgtcactgacatgtaccttaatttcaatgaccttcaagccagtataccgttcaacatcttgctgaacacgttgacaaatttgattgaagatttgtcgcatgtccttaccatattcaacgatcatcgtcatatctaaagcaacttgtttcttaccaacttgggcgtcaaccccctgcgtcgggtcagcttcatcacgaaagcggttcgttaaattgcttaacatgccgccttctagggataacacgccgtcaacattgcgtgaagctagaccggcgattttttcaatcacaccgtcatcaaacgtcaattgagtctgtaattgttgttctggttgtgccattgtaattcctcccattatttagataaatactcactcaacttctgactaactgcagccaaatcgacgtggacaaaccgtccaatcgcccagccgatcagccctaaaactgcgactaataagactgccgaaaaactggttaatacccagacgatacctaaaagcagtccaatcagaaaaccatactgtgcgttactcatcaggaccctcctttacaccacggttaacttacgctggtgatttgctggcttaacttgcactactggttgttcgaccgtcaatcccaattgattcttcaaatagtcctgtgccaaggttgccgcctgttgggccgtggtttctaacgatgcgtcagtattaaccatcgcatcaatttttactcgtacccggcgacgacgccgtaatttcaagtgaacctcaggatcaatcagattcaactgattaacgagtcggtactgcaaatcacgttccaaagcccgttgcggaatcgttaactggccaaccttgccatcatacgtcaacgtgctgactttaactggtcgaaacaagccgacaattaccaataagataccaacgattccggcaataatggcaaagaccatcaataagatactccaaaccattgggtagttaatcgtcagatcagctaaccaggacgtcaaccacgggatcgggtacaactgacccagttcaaaaaccgctaataacaccaatacaattccgactaacgtcaccgtaaacttagctaagcggctcatctaatcaccgcctaacgtttcttacgcatgccgaagattgcagaaacgattaatactaagataatagcgcctaagattgagggtaccaatgccataccagctaacgaaggtccccaagttccaagcaatgcttgaccaatccaggcaccaactaaaccggcaataatattgccaatgatccccattggaacgtcacggctggtaatcgcacctgctaacgcaccaatgacaccaccaacaattaatgaccatagccatcctaacattctaatcactccttacagttatatttgagtacatgcttatgataaccataatttaatttcgggacaattaatatgcacactggtcgaattgtcacttaaaatctgaacaattaccatcaacgaatcccgccgcttcgcaatttaaccacaaacataaaaaaatcagcctgccaattgttacatcgcaagctgattatttctattaaattgactactaataactgctctgacttagctagattaggctggtttagccggagtctgtttggctgccgtcaatgcttgattgattaccttggcgtataaaatatcaccagcccgaatgccaccgaaatgtacgccatccgtccctttgaaaacttctggatgttgcgccgcaatcttgccccagtcggcaaccgtaatgaacttatacttagctggcagacgccgttccaaaacggccaactttgatgaattccagtcagcatcggcccgggcattataaggtgtcatcagaatcaacttgtgccccggctccaagtcatgaatgatcttcatggtttgttcttcgtaatcatccagcgcgttggtcccaatacaaatcaccacgtactgccgtaacgtatggcttcgctgctggttcatcatgactttatatgccaggttcatcgtccgatcgccctccgcatcaatattgctgttcgcgacgtgatcgcccaggtagctccgcgtccccagcgtgacactgtcaccaataatggaaacgcctggtgccttttcttggtcacctttaggcgttgcctgcttcttcttgggcgtcacggccgcgagcacagcttcatgagtcgttccgattttatcaatatcttggtaaatcccgctcacccataaattctgttccagtgtcgaaagttgcggcgcatttttgactacgaccccggtattaactgccaacaacactcctgcggtgataacgggtaactgcaactgtcgccacgtcactgtatgaccgaaaacgtgggcgcgtttgcccgcaatcactggttctaacacgtagtatgacaacgcggataggataatcgacagtaccgtcgtgagcagcgccgccaaccagttgaccatcatgtgtgaaaaaatcacgtacaacggccagtgatagagatacacgctatagctcacatccgctaagaacgtcatccaccgcggttccttgaggttcggcgtgtgatcatgcaacaaccgggcgccatagatcatgatgccagcgagtacagtagccagtaacagcccaccctgatacgtttgtagcgcatcgaacttcatccggtcgcctaaagcaactaacaagataaaactaataagcatcaccgcgcccgcaatgatcggattgcagtgcgccgtggtccaacgatagattggcccttgagctttgatgccgctcaggacaccgataagcccgccgacaaagaacggaaaacagtgggtcagacttgaaaagtagactggtgaaaagtcctttaagccgaccgcgccaaagtacatcatgacaaagctttcaatcgcaaaggcagtggtcaacagccctaagccccaacgaaaacgggtcaatgcgcgccgaccactcgccaaccgccgactgattttagcgaccaaccacgcaatcaggccccataaaatataaaagtgcatttcaaccgctaatgaccacgtatggacaaataagtgcggaataaacttgttttcataactgccacccgtcgcaatttcaaaataattagtcgtaaatccgagagccgccgcgacctgcttaccaatgtcggtcacaaaatcgtgatcaatcaagtaagttagcggtagcaccaataacaccgcaataaataatggtggcacaattcgataaaaccggcgaccatagaaagccattagtttaaagttatccgaacgagcaaactcgtccaccattaatgacgtaatcaaaaaccctgagaaggtaaagaagatgtccaccccgataaagccaccagtaaactgggtttggaaaaagtgatacgtcaataccagcacgagtcccgttatccgtactaaactaaaccatttaatccgcattttctaacttaccgtcccccgtaatttttttggcataagtcttgttgccgacccgcagtttgaccacaccattcaacgcacccttgctgaagttgccttgcaagcgccacccgttcggtgcaatgaattcgcctgcaccttcaaaccggccattggtaaaattacccacgtagcgcccctgtttgttaacctgcaacgtaccctgaccgtcaaacttgtgcttcaaaacggctccgctgtagctcatccgtccgtgatccaattgcacactttgctgcttcgccgttgatggtgttagactgataacggcaaaagtgacaataccgataatcgtgataatttcaaagaccattctgctactgatttttcccatacctctattcctttcacaaccttaattccccttaaagcaatcggcagttagccaccctggatttcccaatcatccacgggattatacggacacattatgtaccatggctgtcaattgcaactctgcatttaataacggatcatttttcattccgttaattatccattaatttaattcgtttatttaaataatcaaaaaaacttcaatggccgtattacttaatatattactaaatattagccttgccgtgtacaaaatatcaaaaatgagttgtcttttattgttaataccggttatgtttaattcactaaacttaatatctaaccactaaaaaaacagtcaggccaaggatttcggctgattgacaaccataggtaagcattcattgcctatctatcattcccggtatccatcggctatcctagtccaactgtttttattatttcatatgatcaataattctaaaaagctttgagctcagaaattaagcgcgtttgcgtaactttgttaaacccaataatgagaaccctgccgctagtaatcccaccacagtcaaactcgctgactgtttttcatccgtttgtggtaacgccgtggcctgtgcggcaactggctgttgtttagctcccgcaaccagcttggttgtcacatcgccatctgaaacatctacgctagtactcgtggcattaatggtaccattactattcgctacggttttagtagctgtcgcatgtggtgcggtaacaccagtcgattggtcaacatttgttgtttcagcaattccatcagccgcagcagccgtcgtcgttgtaaatttgttagcttcgacgcgtgccaagaaggctttagtagccgttaaatcaccttgtgcaacggcgagatcaactctggcagcgccgagcacctgcttaaattgtgctaaatcggtctttttacgatccagttgcgcttttccagcagcgagttgctcgtttgctgtatcgacttgagcctgcccctgcgcgagtacggccttggcagcagcgagttgttgttcagccgtagcaatttgggccttcatgcttgcaatccgcgcgggcagggccgcgatttcggccgccaatcgggcgttttcagcggtcaaatcggctatcaatgtcttggtactggctaagtttttagcggcttgcgtggcagttacttgtgccgcagccgtcttcgcgattgatgtcttcaaattacgaacgggcgataattgttgctgttgcgccgttgctaattgcccttgagcttgcgtcaaagcaacattagccgctttcaaactagttgcagcgacttgaacttgggcctgtttagtcgtaacagtcgcttgtaagccacttgtctggttttgtaaagcttgtaaactggcattttggttagccagcgtggttgctaatgtcttcccggtattttgtaaaccattcaaactagccgttgcagcaatcaacgttgcgttagccgctgcaatcttcttcggatcagcgggggtcgtctggacgtaattgaacgtgacagctggtaaggccttagtcccagtagcggcattcgtatgggcattgtcgaacaaatcaacatacttgtcttgctgcgcttccgtcatcccggcattatcgacttcaaatgccgccacgtgtttggccaagttgatggctactccggcatcaccagtcgagtatattaggttgacgcggtgaccaaaggaaccggactcaacgttattggattcatcataccaacccatcacagcattataggccgtttcttgatcgctcatgaaccattgcggataaacttgtgttaaattttctgcataacttgagccagtatgatccaagccaccgtcgacttgggcagctgctcgcgcaatcgcattattttgcaacgtcgacgtctgtttcaatgctggttgaccattcagcgcccgtagctgattgatatattcaaacatatactgattgattttatccgcattaggcacatacttgccattacttggataggcgacgctgactgtttcggccccagtcaattgagattgtgggaattcggcagcgtcatacttattttgcgattctgtcgtggtcgttggccgttctgctgccgctaaagctgcttgagctgcggtcactttggcttgcgctgtggaaacagcttgattattcgcattaatttgactggtcgtattttgaatcgctgtcttggcagaattgattgcctgggtatttttattaaccgcatcttgcgctgatgctacggccactttagcttgatttgcttgggtggccgctttttgttgggcggcagacgcttggtcaaccgtcgcctgtttagcggcagtgacggcactggctgcatcggcatcagattgggccgtggcctgttcagttttagcttgcgtcaaggccgtgtcagccgcgtccttagccgtttgtgctttcttctcggtagctggctggttggcgatagcgactttgttggccgcaatttgctgttggtcagctggaatttgtgtttcagctgctgccgtttgcgacttagcagcgtcgactttattctcagcctcagcgaggacctgattgttagcatccagtgtttgttgtgcacggtcaactcgggctttaccagcatcatactgggactgtccaatcgcaactaattgactttgattagtcacttgcccctgcgcagtcgccactttagcttgtgttgtattgacttggttttgagccgtgactacgttccccttggcagtctgcacgttggcttgatactgttgctgactagtcggtttgaccgttgctaacttttcgttagttgccgtctgagcgctcccctgcgtggcactcgtctgattcgtcgtatcgctgttatcagttgccgtgtcggcctgcgcattgttaacacccaattgggtccccacgaataatgccgcagtggtaatactggtatacaataatttcttattcataaactcactccaataagctaatataaatatcattataaaccaatgatgccataatgctagatggtgtttacacccttatgtcctgattgaacattggaaagccttatttaatcaggactattatgaattttagtcgttgaagaagtcgcaaatcaggaagtaccattgttccaattttacagtataaagttattttgataatcaacaattgctaatcaaacattacctagttatcattaatagccactgttttcaaaaacaaacgaaactagggtggtatatttctatccgattaacgacagtcgctggtatacttttattcacttgtttctctattgtaaggcccttaaactcctagttgtacctaattcaaaaggagtgagtcctattttcaatcaaatcactatccataaccaacatactgaaaattggcttattattggccttttctgtggggcttttgtgactggtgctgacgcatttattatttcagcactactccccgctatcgctactagtctgcatgtgccgactaacaccgcggcatacggagtcaccgtttacgcactatgttatgccatcggtgcacctttattcggcccattaggtgaccgctttaataaacgttttttgctaatcagtggctgtggcatcttcttactaggaacactactctgtggattagcaaactcattgctaacattctatctttaccgtgccatcgctggcatcggtgcagctttatttgtcccaaacatttgggcttttatcggtacttacttcaatggtcaacgacttaaccaagtcatgggcatcgttatgtcggcactttcattatcaattgctaccggtgtaccactcggtgctttactagcacaactcagtagttggcatatggctttctggggttcagccatgctaaccttgattgcattatcgattttaaccattgccataccttcattaccgagtcagaatgcccagcctgacggttattttacaagttttaaaacattagtccacactcctcacgccatcgctgccctactgattacattaacttggatgactgggttctatggcgtttatacctttttaggtgtttttgcaaccgcgacctttcatttcaacacaatgcaaactggtctcatctttatcacttatggaagtgctaattttgttgcgagtttctttgccggtaaacttatatcattgcttggtaaaaaacagagcgttacaattaatggcttagtttcagctacattagtcttatccttaggcatctggggacaacatttagcagtattgctgattattctggttgtgctcgccttatctcaaggctggggtgtcactgcattaactgcgacaatcgttaatattgtgccatctaatcgttcaaccatcatgtcatttaatagtgcttttttatactatggcttaacgttaggatctgccgctggcggcctgcttttaactaaaattggcttttacgcagtgacgattgcagcggccacggccttattagtcgcagtattgattgcaaatgcacttagccactattcggattagctttgagccaatcagcttttaatgcgtattaaaaaaactgctccgaagattcctgcgagcaatttttatgattgttaaaaatagtggctaataatgacgtcctatacttagtctaagcgttgaccaatcgactacgccaactgtaacgtttcaaggtaagccttcccccatcgatccattgcttcaacgattggaactagtgatactccaatgttcgttaactcataaactgaatgattagcgaccgtttgttgactcacaatctgatccgcaactaattcctttagttgcatcgccaacattcgactggtacagcccggcatgccttttaataaggacgaaaagcgctgcgaactccccattaatcgacagataataattgatttccatttacccgacaagatactcaaagttgtatccaatggacaaaattcttcatgtcgccgactgttctcaattggtgtaattgtacgcatctcgccacctccatcgaaaattgtatcataataatattcttggtataactgaactgtttaatattattaagtgaccaaacaatgattaccactacatcaaccacaccgctattaataaaacaagcagcgcccaaaatttggacgttgcctgttttaattattacacatcacgcgactaatacgcgcatgtcaatcgctacgtcaataggataacctgttttaacgtgaaagcaaagtcaacatgccaaccatggccaatgaattattgataatgtgcaaggcgatactatagcgaatatcgttgaaccacacgtacgtaaaagtcagcacgacggcgatcggtaagtaggctagtagtgcagggctaaacgataacgtatgggcaagggcaaatactaaactcgcaaaaactaatgcaaccgtgaaactcacccaatttgtgacccgcggaaataaccaacgatacatcagcccgcggaaaatcagttcttcgacaatcggtgccaatactgccatcatgacaacattaatgactggactagtagtaaataccttatccaaaatcacttggttttcaggggtttgtttcacgataagtcccgccaacacgttacctaactcaaccaggataaataggcccactatcgttaacaccggacgtgtcggtcgtgataaactggtcacgattggcgcttgacgacgataaatcgttaccagccaccaaatgagtgatccgagcaagactaaacttgccactccggcaattagtgttgccgtggccgagaacccatgtcgaattgctggcatcatcgttggaatcatagctagttgatatagtgcgaatagaccaattagtttaacgatattgaggagccaggtgaccgttcgattagttgaatgcgattttgacatattaagcctcttctctatattttaaagtgtattggagcatcttctattgatgtcattttaacgagccgaatattttttccttccgaccttaacagcaataattcattattaatgatatatcaaacacaccccaactatcacctagaaccattccctatctagagaaatttgacgacctacatgaatacgaactacaacaatacactgttcagattagctaccgaataagtaagctaattgtcccaactttttagtgtgagttctgttctatacaacttaaaaagtaacaatcaataacttcttaattatccaataatggcaactcacgagcggctacctcagcataaggcttactcttgagccgatggtaatcaccaatcaaataaaaatcatgtctagcacgcgtcactgccacattcaataaattaggtttactaaatgcccagtcagcgccaccgtcagtatcttggtcagttccaataattaggaaaacaacatcggcttctttaccttgaaatctgtgaacagtgccaacatgttcttgcaaccatttcttagaaatcgcaccgtcattaaattcttttggcaacttgttagtaataccgttgaccactgcacggaagggggaaataacaaacatttgatccaaacttttgccttcatcacgccgctttttcattattcgtgccaaagcagtcacattttcagggacgaattgttgattcgttgcttttccttttgagttaatccagcgactacgttcaacctgagacagcttcgtcggctttccctgaaccatcttattctcataagaaatttcatttgcaatttcaaacatcggtgaatcacagcgacgatgaacccataacggtattccgacccatgtatgattggacctatgcataccataaatactaccttgatccgcaagttgctgcacagacgtcgtcggcagcaaatattgttctgatactttgaaatcacgcgcaatcgttcttaacgtcgcctcattagtcgtcacaaccggttcaatttgcgcaggatcgccaatcgcgactagatgttttgcacgccacgcgataccaaccgcagaagccggcgtcgcttgaccagactcatcaatataaacattatcgatagtgttctcaccaaaattggcaaacatccgtccaacactggccaacgtcgtactcataaccggaatcaacagttgcataatttgaaaaccagcagttagggccaaagtatcttcagcaaagactagcttatcctgatgcgcgaaaaactcccaagcgttcgagattggaacacgtgcctcacaaataaataccttccgtagccgcattgcagcaatgaataatcttgcacgcttgttctggagaaccctactattgttcggcaaagcctgttggcgtttctcattcgtctgtctccagaagtcatcattaaaaacaacgattccctcttttttcaattgtttttggattggttcaacttcacgaatgattttttcctgctgtgcaattaaatgaacaacatgccggcgttcttttcgccgatctgctactcgttcattgagtccttcaatttttttattcaaattagaaatatgaaatcttagactatcatgtgttggcgtttcgtgttgccagaaaatcaaaaatctttttttcggtaatgttactaatctatgccttgtattctcaattttttgtgtcaagttagcgatttcttgatttagtacctcaatcccctcgtctacaactttcaactcaaggtaagcctgatcaactacggatggattggcccgctcaacgattgaaatcattcgatgtaatcgcgctttttcctgatgaactgcctccaatgccgtattaaaattctgtcgtgcatccgcccaactatccgagtatacacttaactgtttctttaatacgccatgattaatatgtttaaatacctttcgctgattggccttactccccatcggaaccgcaaacattccccaagagtccgctgtctccaaaatgcgattcgctaaatcgctaaagtagtcaatttcttctagctgagtccgatactcatcttgtttctcacgattctcgttaggatactgtctgattttgttacgactcggaaattcctttgaaatattggcaaccgcagaattattattgctcgtcaccacaataccgtacccttgtagggcaggaattaattcataggcattatacttacagttagaaaacaactcaatgggtttaattctccgaaagccatccattggcttttccaattgtgccattactttagcttgttgtacgatcgtatcggcaaacacgtcttgtaatagcgttgtttttccggtccccggtggtccattcactgtttttagatcagtcttaattggtcccttgtcacgaatcacattgactgccacctgctgcatcaatgactgaaagtacttttcaggtccaggccaccgtccatctggtagattttctacatccaataattttgaaataaaatctcgattctgatccacttcttgctttgtcgcaacatcaggatttaaacctaaatacttcaatagtaatgaatcgtccgcagacgcctgcaatacacgctcaatatcctcagtatagaaactatttaacatcgggggttcatcttggatttgaaagagtccccgcaactgaccgacgttacgtgtacctgctaacttaaaagtcttcagtacaatctggttagccagtgccaaacactcagctaagtcggctcgttttcgatcaataacttcttctagttgttgcgacaattggctcttgaagtcatcatattgttgaccatgcatcgcttcctcgatattttcttgccgaagcttcaaataaaaataagctgcataaggtacctcaattttttgaaaggaccagtcgctattaacgattaatgccacactataacccttagcaggatcacgattttgaaccatttccgtatctctaaaacgaatattttgaatgctatctcgtaaatcttgttttttatatgcacctaagtacaaaagtgaaatcgtcacatgttgatcacttgattgattattttgagatattttttcatttattgtacctgattcacgcttctgatacgctgtttttcgtatgtctccactaaaccatttagccttcttgtcaagctcaccaccactaattttttcagctaaatcccaagctcttaaaatctgattagcttgcttattcttcaccctaaaatcctccataaattcataacgatacgcctaccgctttcttcgccaaatcactaggaacaataataatccccagaaaaccagaccttccagcttctcccgatggcttgttttagcaatgcttacagtaatatgcttggtttgaaataatttcacccgttgctcccccttctctaaatttaattacattcattgtacagttctttcacttatcctgacaacctaagctaacaatcaacctaccaatttttagttagtcattcaacaaaaaacagaacgctagattattgcacctccaaattagttgtcattcaatgttaagaaaatacaaacacttagcaacctttacgtttaaccacgaattcgctctaacaaactgaatgcattataattaacaagcaattaatttatatcgataaatcacgttttatattaaatagtttatttaaataagttatttcttaaattttttatttaaaaatataaattttacgtttaaatattatacaatacgttcattgggagactataacatgccagcaaaaacacaaaacaacttcattcgaagactaattaaccttcgtgacagtcggaactggtcgaaaactgaggtggccaggaaattagggttgagcagtatgcagcgatatgccaactatgaatatggcacgaatgagccagatttgaacatgcttaaacagattgcagatctatatgatgtgacaaccgactacctgctgggtgaagatagcgcatctaaatggattgttagaaaagataccactgacttaaaagactttctcacagctcatgtggattcgatgacatacggaggcgaagcacttacggaagaagaacgccaacaagtacgagtagcaatggccgtcatcttctgggaatagggctaaacgcgactaacgccccttacgatgaagtatcttaatgttcgaaccaagttacttcgggcacgcttatggaaagcttatttatcggccagaatattggtcacctttgtttatttatacgaaaaataagcctatcaatacggggattaatggtttgggtaggcttcaacaacttatgtccaataaactgatcgacacgaaaagctgttaataaagggaggagcttcaacatgaagtcaaaaaatttagcacttactaacgggattgtagggctagtcggcggcattattttattattcgggggctggtttattgctggtggcattgttagcgatgctgccactggatcagtatctaatacatcaggtgcggccgctttcctaaacattttgaaaattgctattttagcattaggaattattgcattaatttattataaaggtgataagcgtgtcggtactgcatcaggcgttttactaattgtcggcggcgcaatcgcgcttattccattcttgggttggattggcggaattctcgcaattattggtggatctttatatttagcttcattaaagcattttagtcaaccacaagcatagtctaatttacaatcagttagtaatatcagccctaaaagaacgcatgtgttaacgatagaaatcgactagttaaaccagtacacactgatattgatacttgtccgactgccctaacatatgctctcgtaaacggagtatcttttatctttgatagctttcaatacgattttttattttgtaccatatgctattccaaataaaaaagtggtaccatttcggtaccacttttttagtgattttctttaaatttatcagctttgttcaactttgaaatccttacgaatctcgttctaatgggatagaagtcgtttaatttcaataaattctattcccattcaattgtcgaaggtggcttactcgtaacatcgtacacgatgcggttaacgtgatcgacttcattgacgatccgcactgagatcttttgtaagacatcccatggaatacgtgcaaagtcggcggtcataccgtcgattgatgtcacggcccgaataccaacggtgtaatcgtaggtccggccgtcacccatgacaccgactgacttgatgcctggtaatacggtgaagtattgccagatttcacggtccaagccggcttttttgatttcatcacgtaagataaagtcactatcgcgcacgatttctaacttatcttccgtaatctcaccaataacccgaattccgagaccagggccggggaatggttgacgccaaacaaggtcagacggcatccctagcttttcaccgagttcccgtgcttcgtccttaaataacgtccgtagcggttcaatcaacttgaactgcatgtcttctggcaaaccaccaacattatgatgtgacttgattgtttgggccgttgaagtcccactttcaatcacatcggtgtagagggtcccctgtgcgaggaattccatcccgtttaacttcgtggcttcttcatcaaacacttggataaattcgttaccaataatcttacgtttccgttcaggatcactgacaccagccaacttgcttaagaagcggtccttagcatcaactttgatgatgttcaagccgaacttaccttctaggctcgccataacttgatcagcttcgcccttccgtaacaaaccatggtcaacgaaaatacttgttaattgcgtgccaatggccttgtgcaataacacaccgacgacactggaatcaaccccaccggaaagtcccagtaagacctttttgtcgccaacttcagcgcggatcttttcaatctgcatatcaatgaaatcatccattgaccagttagcttcagcttggcaaacgtcaaatgcaaagtgccgtagaatatcattaccgtagtccgtattccgaacttcagcatggaattgaatcccatataacttccggtcaacatcttgaattgccgcaatcgggcagttcttagaagtggccaccacgtcaaaaccatcaggtgcttgagtaaccaagtcaccatgactcatccacactgactgttcagctggcgtgtccttaaatagggtcgccgagtcactcgtcacgtcaatgttcgccttgccgtattcacggttatcagctgattcgaccttcccgcccgcaagcgtgtaggtcatcagttgcatgccgtaacaaatccccaagattggtaagcccaacttgaaaatctccgggtcaacccgaaaggcgccatcatcgtaaacactgttggggccaccagaaaagataatacctttcgggtgacgggccttgatttcttcagcggtgatcgtgttcggaagtagttccgaataaacgccgaaatcacgaatgcgccgggtaatcaattgattatactgactaccgaaatccaataccaaaatggaatcgaaagacgcggtatccgtttttgccaagttgttcactcctttggattaattaatgctcaataggtctatcatactgatttctaaacgttcggtcaaccagtatgagaaatttcttaggtgctaatatttgcggaaatacacggcatcaatcacatgatgcgcaactttgtgcaaaattaaatccgcacgattacgggttggcaagatataatcattcaagtttttcaagttaacctcttcccaaacacgctcggccatcgccattgcgtccttcggatcaccgatcgcccaaggatagaaataattcgtcggatcctggaaagccgttttcatcagggccttgaagcgttctaagtaccaatcttcaattaaatcggcatccgcatccacatacactgagaagtccgtaaaatcactaatgtagatcgcctgattgcttggcaattgcaacacgttgattccttcaataatcaaaatatcaggatgcgtgatcacgtcaaaacggtttggcacaatatcataagtctgatgagagtataccggggccttcgctaacggctttccgctcttcacatcgttcaagaattggatcagccgcgtcatatcatagctttccggaaaccctttgcgttccatcaattgcatctttttgagctcggcattcgggtataagaaaccatccgtcgtaatcaattgcgtccgccggtctggatataaatatttaaatagaatctctaataaccgtgctgtggtggtcttgccaactgccacacttccagacactccaataataaagggtgattggcggttctgacggtgtaaaaaaacggactccgtttcccgccatgacaagtagtgttcatacttggcctgcaacaaatgcgcaaacggcatataaatatcacggacatcgtcgagactaatccggtcattaaacgcctcaatttcgtgcaaattggctgcggtcaatggtacttgatgctgattgttacgataaaattgcttccactgttcacgtgagaagcgataatagttcatctgatcttccatgatttctgtctgccaccattactaaattaatgggttgattataacatgaaacccttatcaaacgctgattaaaattcaaattaaccggattcctaattggtagccaataaccattaatagctcgatactagttaacgctgacctagtaccgagctatgctactgtatcttattcgattttcagttgtgccgcgacctcacgagcctgaccaaacaacgtcgtaataatttccttgactggccgaattgtcgtcatcatccccgccacttcaccggccataggcgtaccatgttccatatcgccatcttcaacggctttcgcaaatgaaccgtccgctaacgcgtgtaattccgctaccggcgcgttagtttgctccaatcgcaagtattgtgccaacatcgggttaactagcgcccgtaccggatcgcgctggctgcggccagtcacgattgtatccgtgtcactggcagccaatacccgttgcttataactagctggaactgggcactcctcagctgtcagaaagatcgtaccgcactgcacaccctgggcgcccagcgcaaacatcgccgcaatcgagcggccatcaccgacaccgccagcaccaatcaccggaatatcaacagcgtccacgacttgaggtaataatgccatcgttgacgtttgaccgatatgtccgcctgattcttgaccttcagcaaccaccgcatccgcaccggccgccaccatcttatgggcatggtgaaccgaagcaatcactggaatcactttaataccggccgcgtgtagcggcggaatatatgaagtcgggttacccgcaccagtcgtcacgaccttgaccccctcatcaatgatgacttgggccagttctggacagttcttcatctgtaacattaaattgacaccaaacggcttatccgtcagcttgcgggtcgcttggatctctgctcgcaactgttcggcagataaccccgctgaacctaaaacaccgagtcccccagcttccgaaaccgccccgactaattcatgggtcgcaattcgcatcatggcaccagaaaaaatgggatattgaatacctaacatttcagtgattgacatcgtcgtttcctcctcaggtcactaacaaccgttctaactagttgttagtattttcacgatattatgtgcctagtcagtattaaggtcattgtctctcaccgactactgcacttgatgagttaattttaacgcttattccatcgttatgatagcgttttcttagttattccgacacaagtccccaactgttccactactgatcatcctgacgcaccttaagatttccttcacaagtaaaactaaaaaaagtaccactccaggtgaatggagcggtactcactgtcttaaactgacttaaacttttgcttcatttaatgtatacaaggcgtggttcacccgcgctagtaacggtgacaagctacccaccgcgactagcgttaactcgtgcatggcccgtgaacagattgtatataatagttgccgttcatcttcacgttggtaattttcctgattagcgttccacacgatgaccgcgtcaaactccaacccttttgctaagaaagacgggactacaatgacaccaggagccaagcgttgattttcagtttgaatcaacgtgacctgctcaccacgagctttcagggccttcgtgagcgcctcgcattctgctaaggatttcccgataattgccgtcgtatcacgttcagaatcgttcatcgctagctgatcaacgacttgatcaacccctgcttcaaagttaggcgtcacaacgacatttggcaagtcgccctgacgatcaaaagccgtgacggcttcaccattgactaaaatttccttggtgaaatcagtaatctgttgcgttgaccggtacgatttagtcaattgcacgacccgcgtcttttcagggtcaaataatgtggccaattcattgatcagcgaatggctgttttccttggtaaaaatcgcctggttcaagtcaccgagcattgtgaagcgggcttgagggaagctaaacttcaggaacgctagctgaaaggcgttgtaatcttgaatctcatccaagaagacaaaccggatgtcacgctgcccgtgctttccggtcattaagtcatgcaggtacatgtaagctgagaccgttgttaacgagatatgacgttccttaatctcggctagtttccgttcaaccgtagcatcccagtcagcagctgagataccgtgatcagccaacttgatgatcttcggtacttcgcgtaagaaatgcgcgtactgcatgttgatgctcaagaaacggttacgcacgatttgcgtccgggctttccctaagcgttgcatcacaattttacgtgctaagaatttaaactctttatcgccattcttaaattcccgcggcttattgccatataattgattgatctcttcgcgtgataagtcttgaaccgcttcttcgacccacttggaacgcatctccgattcaaccttgcgattcaaaatcttgattaattcttccttagttgctgataaccggttcgctaagtggtagttttcgttgaaagagtagtaaatcgatttaatcttttcccgggaaataatcacttcatcgttcaacgtaatgttacggaaacgcatgtccgcttgttccaaatgtcggccatacgttgtaaccgcgttgaaaaatgcgaggctaccttccaacttcgtaatctttgccatctgcggtgtattttcagtttcaaaccgctgctgtaaagtttcaacttgcatgtgtggtaaccggtacgatgcgtattggaaataagtcatctgaaccatgttttgttcacccagttcgggcaatacttggttaatataatcattaaagagttgatttggtgagaacaagatgacttgtccggccgtcaaattaccccggtaacgatacaacaagtatgcgacccgttgtaaaacggacgaggtcttcccggaaccggccgccccctgcacaaacaggaggtcagaactcgtatcccgaataatggtattttgttccttttgaatcgtcgtcacgatactcttcatcttcacatcggacttttcatccaacacttctagtaacatcgagtcaccaacggcttcatcagtatcgtagactgtcacgatctggccattctcaaccatcaactgccgcttcaacttcacattaacggtctgttcaccatccggagtctggtacgtcacgtgccctaacccaccgtcataataaatactggaaataggcgctcgccagtcgtagatcaaaaagtgatccggcgtgtcagaaaatgaactgagtccgatataaatcgtctcaggcttaggctcaccagtctcatgaaaatcgatccgcgcaaaataagcattcttttccaacttttttaacgtcgataattgcttagtcgcgtgcttccaactattctgccgctcatccatcatctgctgttgctgccgcacggataatccggtctccatcatgccttcgtaactatccgttttaatattgatgttattcagcaagtcacgtttaatatcggcctgatctttttccgagcgcgtaatggtttggctttgttgctcttcagccaccttaattttcgcaaccacatgatctaagtgttcctgttctgcagctttaattgacttagccattgaacgccctccattcctaaatatcgaacaataattttatcactatcggcggcccgactcaattaataacccatggcagctgccagtttttgattttttatgtaaatttgtttgaacattggtctatcaaagttacgattgtgttaaactgaaaagaatgtaatcggttacatctgtttttcaacccgcagacgcttataataaatgcaacttaaactggaggtggcgccgttggtcaatttaataaccattttaacccatttagaacaaagtatcgtcccactattaactacgcttggtagttggtcttacatcttattattcgccgttatctttcttgaaacgggcatggtcgttttcccatttcttcccggcgaatcattgatctttctcgccagcacgatggctgcaactcacagcgacgccctcagtattcagattctggtgccagtattctttgtggctgctgtaattggcgacactgtcaatttcgaaattggccgccatctgattcgcttaccgtggttgcaacgccacctcccccaatccaagcaacaacgcgcacaacaattttttgctaagtatggcgcgaaagctgtcatgtttggccgctttgttccactcgtgcggacctttgtcccgctgagtgccggggccgctaaaatgccacaaacgaccttcgctatctggaacttagttggcgttggtatctgggtcagtgtcggctgttcactcggttacttctttggctcgatcagcttcgtacaaaaccacctctcgctttgttttctaggaattatggccgccgcgctcattccagccacagtggttgcgctgattaagacctggcgacaacggacaacactcaatctcaaataagcgccacacacaacacggttgatctgcaatcgtgttttttttattgcttctcgctttgaaaggcatgtctttccttttcaaaaccactcaaaaagtgtatcctttcaatgacttattcgagtggagggattctatgcaaccaattcaattaactgcctatcaatctgactggcaaaagcaagcaaccgagtatcaaaccttgttacgccagcaattacaggcgaatctattaaaaagtagtcacgtgggtagtacggccatgccccaattattagcgcgtccaacaattgacttggcgttgcttgttaaagatcaggcggctgccgtagctacgttacacgcacgaccggtcgctggaacgacgcatacttacgcgacgcaattagctgctaacgacatccacgtgatcattacaactgatgaacagcattatcagcaattgctcactttccgggattatctcaatgcgcaccggacagacggccgcaagtatactgccattcgcgaaaaaggtgtgcgcaatggacaagccgatctcgcagcctacctacaaacgaaagcagcattcatggcaagcatcaatgacaaggcccaagactggttagccactaaggatcagcatgaacaccacgaccggaccgtccgtgcagaactcgtcaacatgtgccttatcaccaatccagcgaccggcgatgtcctggttgaaaataagattgacgcacagtggtcggggttaacttttcctggcggccatgttgatcgcggtgaatcacaagtaaccgcgatgaagcgtgaagtattagaagaaaccggcttgcacgtcgatcaattaaaattagttggcaccgtaacgtgggtcgaaaatgcggacggcgacgtgtcgcttggtaccttatacaccactagtcactatcacggtgatttgctagccggctcatacgagggggccattagttggcaaccattgagccaactgacgcctgacaaattagcccctggtgtcgaccaaatcctgaaagttttcaccgatgcacatgctagcgaagctttctggggctttgatgatgatcagctccgtgtgtactaaaacgaatcgaggtatttattcatggatcaagtttccttagtcattattttattagccgcattattaattccgcttatcatggctaaattcaaaatcaacagtttgccaacggccgtcatggaaatcattgtcggtatcgtaattggccccagcgtgtttaactttgtgaacacctctgaccttatctcacaactctcaacgattggcgtcatcgtcctgctgttcttaagtggacttgaaattgactttagcctatttaagaagcggcgcacggcgttaacacctttagaacaaaaaaacgcggtcaacacaccgaaatattcgccagttcgactttcggtgtacgcctacagcacaattattgttctatcgctgttactcgccgctgcttttaaagtcagcggcctcttcagtgatttctggcttgccgcgattttatttggcacgatttcacttggtattgtaattgcagctttaaaagaacaggaattgcttagtaaggctttcggacaaacgattctgctcatctcggtctttggtgaacttgtaccgatgatgggactgacgctctatgcatccgtctacggcagtaactcacaaagtctctggttactattactcattttagccgttgccgcactattactcttacggttcaaaccattcttccgcttctatcaaaatattaacaaatcgacgacacaactagatattcggttagccttcttcttgattgtaacgatggtcacggtggccgaatctgtcggtgctgaaaacatcctgggcgcttttgtggccggaatcgtcttgaaactcttgaaccctagtgaaacgacccgcgaacgcttggatgctattggttacggcttcttcatcccgattttcttcattacgactggcgtcgatttgaacttacggaccttattaacaagtggcaaaaccttactattaattccactatttttcttagcatacatggttgccaagattggcggctactgggtcctaaagttacggttcaagcaagccaatgctttagccggtaccgcgctgactgcaacgacaatgacaatggtattagccgttcttcgagttgccaagtcaatgaagacaattactagtgaccagtccggcgctttcttactcgcagcgctactcacttgtgtcatctcacccctgatttttaacaagttttattcagctgaaaaagaagacctggtcaaaacagcggtccactttatcggcgctaacttaagcaccgtacccgttgcacaacagctacgaaaaggctggtacgacgtgtcaatgtacacgaatcatcctgagaattatcaaacctaccacgcgcaagtgccagtgaccttaatggaaaacttcacagcccaggacttacaggatcacggcgtctttgacacggatattttggtactcggccatattgatgccgaacgtaactacgagcttgctaaagccgccaaagcatacggtgtacggcggatcatcgttcggtttgaagaccgcaatgtgctcaacgaacatgaagatgaactccgagagctaggcgtcgaagtctacaatacaccagaggccaacattactttactgcgcgccttaattgaatcaccgtcaaccttgctattgctcaatgatactgaaaacagcatctacgaagtccgggtcctcaaccatctctatactgatgttcaaattaagaacttacagtttgctcaggatattaccattagtcaagtcatccgtaatcggaaactgatcgcgcccaatggaaatacgacgattatgtacggtgaccgcttaatctttaccgggaataagcaaacggccgctcagattcgacaagccttagcaactgctaattaatcgcagtgcattttatggtaaactaaacacattatggcttagttttgaacaccaagtagaggagtaaataatggcaactttttccgtttacatgattcgtcatggtcaaacttactttaacaagtaccgccgaatgcagggctggtgtgattcccccctcacagctgtcggcgaacaggacgctcgcaatgcaggtaaaatgctcaacggtattgatttcgatgccgtttacgccagtgacatgacgcgggcaatgcgcaccgcagaattaattcttcctgccagtggcaataccgatttgacggttcaaccaatggccgccttccgtgaagccttttatggctattttgaaggtgatgacacgtcgcagacctggttcatggttggtgcgccccatcaagcacctagtttgtccgcaattattgaacaatacggcatcgaaaaagccaaagatttctgtaaagaagctgacccgttccatcgcgccgaaaataacgccgaattctggcaacgggtcaatggcggtctcgatacgttacgtgctcaccatcacgacggggacaaagttttggtcgtcagccacggcaatacgatttacagtattgctgctcgttttgccgcactgacctcaccagcacggccccaaaatgggagcgtcacgaaattcacaattagcgacaacgatgtgacgttagactactttggccgcaaagaccatctcgactaaataaggagaaacacatggctcaattttcaatttactttgttcgacacggacagacttttttcaacttatataatcgcatgcaaggctggtctgactcgccgttaactgaatacggacaagccaccgcaaccaaggtcggtcaagcactagcgaacacggcttttgactactactacagcagtgattctaagcgggcaatcgacaccgctcagctcattcgacaagcggcgggtgctaccgcccagccctttaaaacactgatgaactttcgggaagttttctatggttatttcgaaggtgacgattcaagtcggacttggtcactagttggccgccaatacggggtcaccagcatgcacgaacttcttgaacacgtgcctatcgatcagactcgcgacctgatgcgtgaaatcgacccttggcatgaagctgaagacaactcgatgtactgggaacggatcaaccagggctttgactacttgaaagctcaccacgatcaccatcaaaaagtcctcgtggttacccacggcacgacaatccgcagtatggtcgcacattttgctcctgaaatcgacatcacgaacggccccaaaaacgggagcgtcactcgcatcgacatcgatgacgatcaaattcgcgtcgtcgattatgcgcaagacttagctgacgtgaaagtcaatcaacacttataattttgctcatcaaacaaaacgctcgcaaccactgactggtcgcgagcgtttttatattggctctgaaataactgttgttggtaattaactaaatacgtgattactggcgacagatatctttatttgtattttaatcatgggctattgaacaattcgaattgaaaaaggtgctcgccattgtttgactaagcacccgtagcactattcgcaacatcaattgacagagaaccaactcggctatcttatcaatgatgtccttaaactttgctggttaaagacgtgtttgaagaattcaggtatgctaccccaattcaaactattttttcaaaaaagcaagcacgttcttcttagacggtttcatgcttcctgctaagaacgcaattacgactgccacaacagcaaacaaaagttcccagactgaccaattaaaaactaccgttaaagctaacataatagcagctgcaattatcaagacgccatctctggggcctaaattcagatacggatacatcatcatcagacgtcacttctttcactatttgttgtactcaaccaagactatacacagaattactgacgaaattaagaaacccctccgagaggtagtgcgttgaccgggtgtaacaagaaaattttgtaaagtcttggcaacagtgcgtctatctcaggtcggaagaagtctaagaataacccaaatattcatttaacttctaaagttattataacaccgctttcatgcttgtggtcattcttttataaaaatattgaaaagctgttggggcttcactgatgaatcacaaacccactaacacccccccaatcctaactcgtgactttgataccaataatgccaatgaccagcattgcaatgaagatccacgtgatgggtgcaattgtatctttgaagaaaaccaggccaacaattatcgcaccgaccgcaccgataccggtccaaattggatatgcaatactcaacggtaagtgtttggttgctaatgctaagaagccaaaactcaagaccatgccaactactgtggccgcagcatagccaaagtgactgaacccattacttaatttcatcatcgtagcccataccacttcaaataatccagcaataattaaataaatccacgtcattatcaattcctcctcaaaataaaaaggacaacgtccacccaacttccacaatgacctaaggaagttgggttaacgttgtccggtgacaattcatcttaatatttcagtccactatagcaaacctcatctgcatggtcaagcttactcaccgcaaagcatccactttgtcagtggggtcaacggtgtcggcaaagcatctaaagcaaagaaagccgcagtactcgtctcatcggtggcttgaatcaattcaccacccgttgtattggcgcgatataacgtggtgacactgtcaataatgtccccgttaggatactgatagtgcatcttgggcccactatagacatcgatcagcgttaactcacccaccgtcagcccagtctcttctttcaattcccgtcgcgccgtttgctggaccgtctctcccggttcagtcgatccagctggcaagccccaacagtggttatcggttcgataaatcaagacaattttgccaatcgaattttgggccattaaagccgcaccggccactactagcggttggtgaccaacttgccgccgcaaatcaagcacataacccatttttgattcctccctaatacccgaagtcgtaatattttgattagacatgttatacttaatgcaatcataacacgttaggagtgagtgtatgtctgaaaccaacgctcaaaaagtacaagaagtcatcattgccggcatgtctaaaacggtcgccaattacgactacgccatgtccgagctagaagcgctcgttgcagccaataatatgcacgcggccctgcgaattgaccaaggattggaaaaacccaacccggccaccttcttcggcaaaggtaaagttgtcgaaatcaaagaagtcgcagccgccaacgatttgcacattatggtcatcaacgcggatctgacccctagtcaggtgcgtaacttagaggaacaaacggacattcagatcatcgaccgtactggtctgatcttagaaatttttggtaaccgtgcgcggagcaaggaagccaaattgcaagttaagattgcccaattacaataccaacttccccgattacgaacgagtatctccaatcgccttgaccagcaggctggggccgctgctggtggtggcgggggctttaccaaccgtggtgctggtgaaacgcaactggaattaaatcgccggacaattcaagaccggatcagtcacgcgaagcacgaacttaaggaactcaataaagacgaagtagtgcgacgttcacaacgcgataaagccgggctccccaacgtcgcgttagtcggttataccaacgctggtaaatcaacgactatgaatggtttagtgaaactgttcggtaagggtgaagataagcaagtcttcgaaaaagacatgcttttcgcaacgttagatacaagtattcgtcagttaaccttccctgacaataagcagttactgctcagtgatacagtcgggtttgtcagcgacttgccgcataacttgatcaacgccttccgttcaacgctagccgaagctgccaatgctgacttactcattcaagtcatcgactacgccgatccccattacaaggaaatgatggcgaccactgaaaagacgctcaaagaaatcggtgtgcacgatgttcctatgatttatgccttcaataaagctgatttaaccgaagccgactacccgaaccagcaagatgatcaactcatctatacggcgcgtgatgaggcctcactacaagctttgaccagtatgatcaaagccaaagtctttaagaattacgtgacaacaacgttattaatcccgttcaatgatggtgaagtagtggcttacttaaatgaccacgccaacattctcaaaacggattacttagttgatggcacccaattaacagtcgaactcaacactgtcgatgcccaacgttatgaaaaatacgtggtgacacctgcttaaatgactcattcaaaaagatggctctaggattaaccgcctagaaccatcttttttgatttaacaatcaacccactctgttaatcgccaaaccactagtgccaatagtgaacatcattcagtcaccattaacgcgtgcaattgcgccaatagttcggactgcgaccgtcctcgccattgacgttgaaaagcataactagtccccttcagcatggcaattaacatatcagcttgaaactcacatgccggtttcgaaagcgttggctttaaatcacgaaccagttgcgttaataggtcacataattgttgataaagttcgctctgataaaattgacggcgaccaggttcaccggcctcgacattcattaataacgccatgttgtgctcacgaatcgctaaatattccccaataacatgatcaaaacgtgctgctgcacctaccgaggtcgtggtcaagtagacttgattggttttaataaaagttgcgactcggtccgttaccaatgccaaacatagtgtacttttatggacatagtgacgatacaacgttccgggaccgataccagcggccgtcgcaatatctttcatactaacggtttcgattgaacgcgcggcaaagagttgtcgcgcagcagtcaaaattttctgttggttaatttgtgcatcctttcgcattcgacacaccctcctatttacttaagttcaccatacacttttacgcatcacttgacaaacggagtgtactccgtttaaggtataattatacaatttaagggggaattcactacgtttgtctttttatccggattactaatcggcatcttcgttagtctgattggtggaggaggtgctgccctatacctaggtgtcttaaccagtcaagtaggccttgcaaccgcggtagccgtaccaacctccctaatcgtcgccttaccagccttattctttggttttctaacacagttgaaaatcaaaaatgtcaatttcaagattggcaatcaaatgattattgcggccgttcccggtatcatcgtcgggacattcagcgcacaatttattccccaacaactgtataactggattgtcgggacaatttttttgattatgggtgcgatggtactaatcaagtatgttcaccattctaaacaaactacagccggtcaccaaccttggcaagctgccttctttggccttttaagtggattgatggtcggcattggcggcttaagcggtggtgcgaccacggctgccgggttagcaattcttgggttaacggccgttgaagccgctggtactgccacctatgtgttaactgttatgtccacaatcagtttaatcggtcatctctttactagtacttttgcttggcaatcaggattggtcctcatgattggcgcaattatcggcgcaatcattacaccactcgtgattcgccatttaaatttagataaggtcaaccgcgtattaacgccatttcttggtcttattattatttattttggcatcaaaatgtttatataaaggcagataaaaagtcacttcagacagtcgtaaacttgaagtgactttttgatatcccctactgaaaaaattcataatcatgtgtataccaagaacaaccttctccagcatgttggtggctaagctaactgccgacgactgactaggtaaacaacgataatcaatggcagcgtcaccatcatcacgggataaaaccacgccattggtaattgactgctaatcagcccgccaatgatggggccaagtgacattccgagatcaacaccaatataaaatgtactattggctagcccatgatcagctttcggcacgagcatcaatgctttagcttggcaaattgaaaacatcaaaccgtatccggcggccagtcctgctgcacccagcagtagcatcgcccaattgttcatgtcagttaagccaatcaatcctaatagattaaaaattaagcataaccagatgaaccgtttaaatggcacccggtcgaaccaatcgcggagaataattcgcaatactaataaaatacccgcgtacaccgggaaaaatacccccgctgccacatgaaaatgccgtgcagcgacgtagctgacaatataggtttgggtggcaaaatatggtaatgaaaataaaagcaaaatcaaggccacggggattactcgtggttgtacgatgcgaatatggtgcttagtcgtagccgtttgaggcgtcacaattggttcaccatgatcaccgacgaattgaatcatgatgacgagcagtaaactacagcccgctgctaaccaaaaaacactctggtaactgtaatgttgatacaagaagacactgattgccggcccgcacgccattccaagcgcattcgctagcccataaatgcccattccagagccaattcgatcgggtggcaataaactagccatccaggttgccatgcaaactgaacacaaggtatatcccaacccattcaaaattcgcaataacatgattaacgtcacgttggttgtcaaactataacctaaactagctagtagcaacaaacagccccccacgaaggtcaaacggtacttagagacccggtcggttaaattcccagcaagtggccggagcactagcgatgtcaaattcgttaacccggcaatcgtaccggcaagcacactactagcgccaataccgtgcgcaaatcctgcaatcacgggattgattaacattggactcattaaaaagaagaaactagccattaacactaactttacatccggcgtatataaacgcgtcttcatcaattctcatcactttctaaattctgattaacttgccgtaacaaatctaaaaatacctgttgttgttcggcatccaaatgggcaaacatttgcgcactcgtctgccagccatgttgacggagctgctcgcgtttagcacgcccactcggggtcactaccacttgcttggcacgcgcatccgttggactgaccactaattggacatatccgcgcgtctgcaagcgttgcacgatcatcctggccgtctgatgggtgatttcctggtacgtcttaaacgcggttaccgtgcgacctggctgatccgtaaaaaaagtcagtgcatccgcttgctcagtcgttaaccccaccgtccgcaaatgttggttgcgacgccgcttgatttgacgagctaaaatcagaacttgccgcgccaccatttcatcatgattcatcttaatcacctgccctttcatttatacagccagctgtataaattgtcaaccagcgaccgctattttttctagcagcctgaaaatcattttaaacaacgacaaaaaagtggctaggcttggttagcctaaccactcataccgttgactataacacatttttccggcgttgcgcggcacgccataacgaaaaggccgtccaacagctcactaagacgatcaaccaactcagggctgttaaggacagtgacttaactaaggtcgctgccaccaccacgccaataataccgcctaaaataatgccgaataagccgcgataatcgacgcggtcatggcgaataaaattcactgccgaaatcggcatcaacaatgcgcacgacagcatcataattgggaaggcggcaatcggggtcaatcccagaaaatacaccattaccatacacggtgcgtacagtccgactccggctgacatcagtaaccctaggataaagttgccaccaatgccgaccaataatttccaaccggatagccccgtcgcctgattagcaactcccagcaaactgatccaacctaataacttcgctgccatcagtaaagcagtgatgactaacgcaccggccatgattaactgaatccaccgctgattaagcttcgtcatgacttcactacccagtaatgcgccgagcgttgctgctaaaactaaactaatcagtgtcactggctcgaccgcaactgctgtaacaaagaaaaacgcctcaaacgcggtcggaatcgcatgcatcgtgttcaaagttccaggtagcttacgttcatcctttaaataatggctcgcttgaaaaattgccgtggacacgacgaaacttccgataccaagtgtgtcaagaaaatccgtcacggccccgataaccatgccgaaaccaaaactgtggtcaaaaaatggcgctgcttgccgtctggcaccggctaacagcaacccaaataagccgatgctgagcagcatcaacaacaccacaattgcaattaccatcaatctaaccccactctcttacctactcgtagcattatactgtatttttaggaaggaaccaaaaattattaccatgacgtcactgcaagtggtacccacaatcatcagtttgcatactgaacgtgaccaccagaccataagatcccaccggcactagggcaactaggcccacagattgtcagaatgtgctataatccaatcaatcgattgtgcacaatcattattagaacgtctccgcacttaatactcatcgcatgaaaggcggtaattatcatgaagacaaccacaattcgcccccttgaagaccacgtctgtttttcaacctacacaacagtccatgccattcaacgcctctaccaaccaactttgacagcacaccgactcacttatccacaatacttggttctagtcgcactctatgcgacaccgccgcacgctgtcacggtcaaaacgttgagcacccagctaaatttaagtacgggaacgctgacgcccgtgctacagcggatgacccaagctggtttaattacacgtcatcggaatccccaagatgaacggagcatcttgctcactctgacacctcaaggaaccgcaacacgacttgctttaaatgatttgccggatttattgactgctaagggtggtctcaatcaatccgagtgggcacaactaactcaattaatgactaagttaatgactaacctgacccgttaaatacccctgctaatattaggaagataaataaattaatttaaagccaccatgctgcccaatcctattttgtcgaaactcgaatcaccaaccgaataacactgatcattttgaatcttgtcgaactttattattaaaatatcgttattagttcggatttagggtgaaaaatcggccacaaccaacgatatttgattgtcatcaccattaatctctggtatgctaagtgcaatcatttagaatttggttgtttcaagggaggatttcaggttaatgcaggaaacaaagcaagcaacgaccctgaaccgttcactcggtttttggtcagcactttcactcgtcgttggtacggttattgggtcaggaatcttcttcaagcaatcatcagtccttgatagtgcgggctcaccgagcgctgcgttactcgcctggttactaggtggactgattacgttgaccgcgggcttaacaatcgccgaggtcggtgcccaaatgccgcatacgggcggactctatgtctacatggaacaaatctatggtaaattgtggggctttctctctggttggatgcaaatcgccgtctacggtcccgctatcatcgcttcaattagcgcttacctcggtatattactagttggtttcttcaacctgcaggcgggttggcaggcgccactttcaattggcgtcatcgtcctgattggaatcctcaacatgttcgaaaaccgttggggcgccgcatttcaaattgcgaccacgttgggcaaattattaccgattgcggctattattatttttggactcttctatggtaatcagaacgcgctgggacagtctttacatacaattacccaatcaacgggtagtttcggggttgccgtcctcgcaacactttttgcctatgatggctggatcttagtcgctaacttgggtggcgaaatcaagaacccgcagaagttattaccacaagccattattttagggatttcaatggtcttgattgcgtataccttagtcagctatgggattctccacttcgtacccgcggcaacgatccacaaactcgggcaacaaacgacgctgtactttgcccaagcggcgtttggcacaattggcgggcgcctactgaacattgggattatcatctcgatggtgggctgtttaaacggcaagattatgaccttcccccgcatcgtgtacgccatggctgctcagaatcagctgccattcgctaaacaactcagttacttgcacaaaaaatcacacgagccgatcgccgcaaccattgccattctcgtttatgctagtattatgatcctgttctttaatccagatcgcttatcggacctctgtatcttcacggtctactgcttctacgtggcaaccttcgttggtgtctttattttaagaaaacgacgcccagcttctgagcgaccattctcgacacccggatttccgatcacaccgctgattgcgattctgggcgcactgttcgtgattatcagtgaaattggctcagacttatctggtgtactgatttccttggttatcgtggccgttgggttcccaatctattattggaagcagcagcaaaatcaaaatgcttaatttaaattcttgataacttgtaaaagagcgttgttactgaagatattttcagtagcaacgctctttttatgcttttcaacgcgcattgaaataagtgatttaatttgcttaccgattaccttaacgcttagtaactaaacctcactatatttgattaatttgatctgctgtcgttctaaccattcctgcatttgaggatctgttaacattgcgacttcttgcgtccggggaactgtcaggcttgaatgttgtaataagtagtcatccaaatagccaggatgacaaaccatcatagcatagccgtcattatattgggctagtgccgcacgtttcaacgtttcataagggttatagtttttgcccatactttccataaaaacatgtaatacctttcccttaaatagcacactcggactatctgggcctgctgcaaagcgtaaaagatttaagtgatgacgttcacccacaatttccaatcccttaacaaagttatcactaactaccgcatgaccctcaaaataatcaggctggcgaccaactaacgctacaaatttttgatattgcgcttcgatttccaaaacaacttcattaagatcgacaaaatcatgaacagccgcccgataatccgaggaatgacgaaaggtaccatctggattagtgatgctcggaatcaattttggatttgttaatggccggccagcagatataacagtatgcaaccctaagcaaacccctgcatctttaatcatggctaatcctgacatcgtcgttggcatattgaccataacacccacattattaattaacccgttgtgaactgttcgtgcaatcccaacattaactgcatcggaataacctaaatcatcagctcgaacgattacttttctttccattagcttttaagcctccactagtttaaattctttagtcccctgtttgtttgtattggcttcaacaccaatcgcataagttgcaatagcagctgctacaaacgcaatcacgccactaaccacaccgttaatcacattagatgtttgcccgccaacatacgcagttaaagataaaaagtttgcaacaggtaccatgacataagctgtaactgttgtcaggccagcatataagccaccgcaaaatccaccaatcatcatgccaataaacggtcgtttataacgaattgctagtccatataatcctggttcagtcacacctccgataatactagcgattaaataaccccaagcaagggtcttttgatcttggtccttaattcgtaaggccgcacccaaacacatgcccgcgaccgacatactagcggcaactgcgccaagtgtgacaaagttttcatgacccgattgcgcaaaaatcatcatcatcgtcgtaagcattaagagatgcatcccggtcataaccaagatttcccataaggcaccaaccactccaaccgcgataatcgttggcaagccacctaatttcccaaaagctaatattcctgtacaaatgtaattgccgataaagtttcctgctgggcctaaaatacataacgaaatcggcaacatgattgcaatcgtcaacgttgggataacaatcgtactaatcgactctggtacataacgcttaaagaaccgttcaatatacgacattacccaaaccgacaaaataattggaatgaccgtacttgaataattaactaatggcattgcggtaccgaagatattaaatgccttgccagcagtcacaattttaattaaattaggatcaatcaaaattgcacctaaaaacattgaaataatccgtgacgtattaaattgcttagcagctgtatatcctaagatgattggaaaaaagtagaatccagcatcaccaaccaacgtaaataactgatacaacgatgttttagtaccaagaacattgaacatgcttggtcctaaaatggccgcaaacattttaaacattgatgcagcaatcaacatcggaatcaatggtgttaaacatccagccaatttatttagaatcatatttcccgcagacttaaacgttaacttttctttaggtcgattatctaaatcttcattaattggcgcgtttctagttaaattacccaccgtaagtaacgcatcataaactttgctaactgcttgtccaataatgatttgatactggccaccagcgcgattgacaccaatcacacctggaatattctgtacctcaccatcattaggaatactttcatccttcaaattaaaacgtaatcgggtcatacaatgtgtcaccgaagaaatattcgcactaccaccaactgcttccagtacaccattcgccactttttcatactgtttatccttatttttcatgtcgcatacacctccattaattaacggttacgcttgagtattcattttattaacgatccttttaacatatatcattaggtagaaaagttcatcatcattactattagtatcaagttgactatcaacgtagtctgcaattcgctttgctaccaagtaaatttcaggctcatcatgcctcatcgtattgaataatttagaattatcattttcagaaatttgctcatgtttcttcatccgtttaatgtaataccgtaaatgcatgacaaaccggttgtatgtgaattcggtttgattgattctaagctcatattcttgttcaataatttttgtgatgatttttatcatttcatcgtcgctatttacacttgaattggtcgctaaatcattagtctgagaattgacaaaatgcatggcaattgctgtgacctcggaaactggtaattgaatatttagccgtcgattaattaacctgacggcgtaatacccaacatccgtttcttgtgggtataattgctccacatcatatgaaaatggtaactgggcgcttttataatgggttagtcgcgttattgcaaagttaatatgatcagctaagctaaaaatcatatttggattcaaaattcttggaattagtgcctgcgctcgctcaacaattgccgcactcaaatcaaagatttcagtgggtatttcttttagtaattgatagtattgatagtttaatttataaaatgtcatcgtcactttggtcatatcagtaagctcatacgggactttttgaaatcctaatcccttaccaaaggcgaccaattcttcaccatgttgatcaagacaaacgaccacgttgttattaattttcttcaccacccgcattttaattcgcactcctttacatagtttatgcttgctttaaaactggtgtgccggctgctaattgttgatgaagcttactgccaagtggcacttcgcccgtataaccttctgtaaagacaactatggtggtcatatctaatcccgcggtcgccatcgtttggcgatcgagcgtcactaatagggtccctgctttaacttcttgatttaatttgacgtgtgccgtaaagcctctaccatttaagccaactgtatctaggccaatgtgaaccaatacagacacgcccctagtctcatccatgatgccaatagcgtgtttactttcaggtaatgcaacgattttcccactaatcggtgccacaacttgattagtgtcctcactcggcctaatagcaaatccatcacccatcattttctttgcaaacacttcatccataacggccgtgatcggtatacaaataccttcaatcggtgtaaccacctcgaagacatcaactttctttcttttaattccaaacatcactgaacctccttcaatacaaaaaaactccttgaggcacccacttcacccgtatatttcaacaagtaaaaggtaatgcctcaaagagtatgagttacaatccttaatttcagttttatagaaaacgttttcagtaactatattatcacgccttctattttttgcaagacatttaaatattttttataaaaaaggccaaacaaagcattattgcttgtttggtcttttcattaaggaatttcagccatcatcccaccagtttaattacgctaacttcttatccaacacacgtgacagaattgacaaggcgtaacaaataatgaagtacatgactgcgatcattaagaacatcggtaaaatatacgctgagttctgaccataaataatttgcgcatggtttaataattcaggtaagacaataatggttgccagcgacgtatccttaatcagtgagataaattgactcacaatcgttgggatcgtcttcttgattgcttgtggaaagacaatgtgccataacgcttgtacatagctcatcccgttagcccgggcgccttccatctgaccgtaatcaaccgccaaaatccctgaacgaatgatttcggctaacatggccgattcaaaaatcgtcatagcgaggatggctgcaaaaatgataccaggcttgaatcccaagtgtggcaagccaaagtaagtaaagaagataattaagatcaatggcaagtttcgaataatgtcaacaacaaacccaaccactgccgataaatatttaatcttgacgtaccgaagcacccctaggactgaaccgataataaaactggcaatgatggaaacgacggacacttccaccgttacccagagtccttcgagcaagaaccggatatttatccacgaatacgcttgaataaagttttgcatgaatcgtcgcccccttctagtttgctaattttttctctaagtgccgcatgtaataactcagtggcaacgtaatgattaagtaaaagacccctacgaccacgtagctattgatcgtatcaagcgatagtgacgcaattgaatttgcttggtacatcaagtcgaacccagccacgaaagctaggacagaagagttcttcaccagattaataaactggttgcccaacggtggaatgatgattttaaatgcctgtggtaagacaattttactcattgcctgccagtacgtcatcccattagcacgggcgccttccatttgtccaggatcaacagattgaattccggcccgaaccgtttccgcaatgaatgatgaggtatagattgttagcccaattgtcccggcagtaaaaccatcaatcttggcaacatacattggaatgatcacgtagaagaacatcgcaataactaacaatggaatgttccggaaaatttcaatataaactcgaccaatgatgcgcatcgtacgacttggcaaaacttcaaagatagcaaacattgttccgatgatcgtactgaataccaaagcaatcacactggataacaacgtatatccgagtccttgaatcagctctgaccaatagtgcgttagaatgtatcccattagcgtgacgcctccttatagtcgaagccggccacgttaccaaaccacttcttcaagatgcggttgtacgtcccgtccgcttcaatttctttgagcgctttattcagagccttttttaacggttcctgacccttattaacagcgatcccgtatggttctttcgtgaaggtgcccccaaccacttcgtaccctgggttttgcgacgccatcccgtaaagaatcccgttatcagtagtcaacgcgaccccctgaccagatttcaacgccgtcattgcctgagcatagtcggataattccaacaccttagccttaggcgctgctttcttaatgttctcaacggagtttgcaccggtcacaccaaggaccttggtgcccgacttattcaaatccttaactgattttatggcactgccctttttaaccaacagtgattgccccgcatcaaagtatgaattcgtaaaatcaacctgtttttcacgttccggcgtgatagtcatcgtggcgataatggcatcaatgttcccattcttcaacaatggaatccgcgtttgactcgttacttggacaaacttggcggtagcattcttaccgagcacccgctttgttaatgccgtcgcaatgtcggcgtcaaaccccttgatttgattatctttaacgtccatcaacccaaataatttcgtatcagctttaacaccccacgtaatcgtcttactagctttatcattggtcaaaacatcctgttttgctaatgattgccgtgaaccgcaagcggttaagaccaccactagcatggcaagcatgccgagtgcgccaattagtcgtttcagcttcttcattcgtggtcctcccctacaaattagtgtgtaataattttactcaagaattgacgggcccgttcattagacggctgaccatcaaagaacttttctttagcatcatcttctaggatttccccatcagccatgaaaataacccgatcggccacttcacgagcaaagcccatttcgtgggtcacaactaacatggtcatactggagtcttcggcaacactcttcatcacgttcaacacatcatcgatcatttcgggatctagtgctgaggtgggttcatcaaacaagagacacttcggcttcatagctaaagaacgtgcaatcgcgattcgttgtgattgcccaccagataattggctcggtaagctattggccttgtcagccagaccgacactatctaataagtccatcgctaattttttattctcatcttccggccgtttcaagactaaccggggagcaatcatgatattttcaagcaccgtcttgttagcgtacaaattaaagtgttggaacaccatcccaacgtttttgcgaattttattcatatccgttttgcggtcggctaaatcaaacccattgactagcaattgacctgactggacacgttccaaaccgttaacggttcgaatcaaggtactcttacctgagccagatggtccgatcaaaacaactttttcaccttcattaatcgttaaattaatatttttgagggcgtgaaaatcaccataatacttttcgacgtcgtgaaattcgatcattgacattgcagtcaccttcgctttctctatcagcctgttgactgacggtctagaattattgcattaataattagagttaagaaatccttattcttcgttaatgctatttaaatagtttaatacataattagtaattttgtcaaaaagtagctaaatattgttcgatatccataaaatagtgagaaacagctacactgttttcagttaaaatagctgaataacagctccaatattgaacattattcgtgaaaagccaataataattcgcttttctttttggaactgccacggccgaataatttttagacaatgatttcaataaaatttatattattctaacaactaaacttaacccgcttttaatcataccactactgaaagccaccgaagcgtccggcgcataattttcacaattagtggttttaactaactgaactttaaaaattgttaacgcttccgcaatcatttctttaataatcactgctaacctagaactattaagaaattaatcatctgcattgtaacgggagacgataatatgttacttgaccaagcagctaacatgactaacattatagcggcccagattatcaaagtcttttatccctttgtgattgccaagactgagacgggggcctacttaaaattgaatttatccaccaatgaacaacgcgatccactcttctgggatgagctccgtagcattctgcaagctaaactgtgggtgccaatcggtaagcactatcaccagttattagataatggctggttagccgaatctactagctagttagtcacgaccagtcagccgactcaagagacaaataagccctccaagcaatatgcttggaaggcttatttcattgccagtacacctgaagcccagtcgcggacgcaccaccaaattagtcccgctataagctagatatcgaacagcgagtcgccgaacaagttaaccggtggggcactttgaccagccaccgtctcctacagccatactggtagtagcggctgacgccatcattaaaaggcgtgggccgtcgtttcaccattcagaattgctaagacgtcatccaggctaatatcgaccatgtttttgaccgctaaattcgtatagaaacccacgtgtggcgtgataatgacgttgggcatctgcattaattgtgccacgttggtatcttgaagcacctcaccctgatgattttggttaaataacgcattttcaccctcaaccgtatcgagtgcacaaccggcgatttcaccggcctttagcgctgccacaagatcatcggtgacaatcactggtccgcgtgaggcgttgataaggtaggcatccgtcttcattaacttcaaggctgccgcatcgatcaaccccgcagaggtctcattcaaatccacgtgtaaatcaacgacatccgcctgccgcaataggtcttccttagtgtcaacgtaggttaaaacgtcttcgagttcaggatggcgtaccacgtcataggcaatcaccttggcacctaacccgtggaaaagttgagcggccgtgccaccaatacgacccgcaccaataataccaacggttaatgatcgaatttctcgtgcttgcagtcccgcccactgaaaattctgttggctgattcgttgatcaaacatttccaagttgcgaatcaagcgcatggtttgtgccaccgacatctcagcaactgaattaggcgaataggctgggacgttcgtgaccacaagaccagccgccttggctgccggaatatcgattgtatccacaccagccgtacgactcgttagttgttttaacccggccgcagctaatgattggtataagctagcatcaccaccaattggactgcgttgctgaatgaccaagccgtcataacccttgaccaggtcggcagtttctggatggaattccagatcattcgtatctacttgaatttgatgagccgcagcccacgcttgaatcgcatcctgttcatcatcgcgaacactatacattaaaattttcatctttaagccccctgcttcttgctggcaacgtacgtcctgatccgcgtgaccgccgtcttaagatcggccatcgaagcggcataactaattcgaacatagccttcaccacccgggccgaatgagctacctggaatcagagcgacacgtgcttcatgggctagttcacggcaaaaagccatactattttgtggcaacccggctggaatcttactgaagagatagaaggccccttctggcttagctgattggaacccaaggtcattaagtgcatcatacaaataatcgcgccgttcttggtactcccgtttcattacttgggcatcatctaacccatttttcaatgcttccgtcgcagctgcttgagcattggtcgtcgttgaagtcactgtgaattggtgaatcttacccagttgtgctgtgatagctttcggcgcacacatgatgccgattcgccagcccgtcatcgcgtgcgactttgagacgccgttaagcaaaatagtttgtgttggtaagtaatttgcaatcgattcatgaggctcaccatacgtcaattcgctataaatttcatcagacaaaacaaaaattggttgatcagctaacactgcggccagggctttcagatcatcatgccggtaagtcacaccggttggatttgaaggaaagttaaggaccaccgttttcgtcttggggtgggctgctaacgtcgtttgtaactggtcaggcgataacacgaagccattgtccgaggtatccatgaagactggtgttgccccagctaatttaacgattgcgatgtacaatggaaaaattggggttggaatcaggacctcatccccaggattaaggattgaagtcaacgctgtataaatgcccccggtcgcaccagctgtgataatcacttcgctagcaggatcataatggacatcatacttagcggccaagaattcagcggcagccgtccgcaaggccaacgttccgttcgagggtgcatagtggctttcatccgcttcaatgctttcgattgcagcttgtttcacgtgctcaggtgtattaaaatccggttcaccgagggtcaaacgcacgatacccggaatatttgcgatttcagcgttgaacgccaaaatatcagacggctgaatcgccgcaatttcatgattcatatggttaacaagtgtttctgaattaattgacataaagattcctcccaagtttggctgatcttgttggtggaagcggactggactagggtcaaaaaagggcaccccttgaaattccaaagggtgcgccaccacgcagaaacaaacttattagccacccttggaattttcaaacatccatgggcgccgtcaaatcacaaaatactcttggcaaccgcatcgatgcaaacatcggattcgtgtttgcacctctgcagccggcacaaacactagcgaaaataccaaaagtaaaagctagttctagattttaatgaatttaacggtaatgacatatcattagctcctcatcaattgttaatctaactataatggttgtcctaaccactgtcaaggacgaatttgctatactggagttaaatctactttggaaggaacgattatatgacttaccaagcattaatgtttgatattgacggcacgctgactaatagccaaccagcttacacgacggttatgcgtgaggtacttgctacttatggcaaaccatttagtcctgcccaagcgcagaagacttttcccatggccgctgaacaagcaatgactgaattggggattgcagccagtgagtttgaccactttcaggcccaatacgaagatgtcatggccagccattatgatcagattgaactttatccaggcattaccagcctctttgaacagttgccgtctgaactaagacttggaatcgtgacttcccaacgacgaaacgaattagaaagtgggatgcgctcgtatccattcatgatgcggatggctgtcacaatcagtgcggacgatacgcctaagcgcaaaccagatcctctccccctactcacagccctcgaaaaagtcaacgttgcgccacaaaacgcactcttcatcggggattccgtcagtgacgaacaaactgcccaggccgctaacgttgattttggactggcagtctggggaatggaccctaacgccgaccatcaaaaagtggcccaccgcttccaaaaaccattagacattttagcgctttttaaatagccataccgacaaaacaaccgtttcgagccactgctcaaaacggttgttttgtgtttagattcaatttggctaccgaaacgtgcttccaaaggcagtttgctccgcttaactccagcttgccgaaacgtgctaaaagacacagtcagttccgcttaaccctgttaggctgataatccaagcccaggattatcagcctaacaacgttaatgctcgctgactacccgtgtcttttagcactcttaatcttctcttccctcatacgcaacctgcgcggttacctggtaatcgcccggttgctcgatagccgacgttcggcccgcaatcttgctcataccacctgtgattaccgtggaggccaagtacaacttataatcctcatgcgcatcatgaacatcggtcaagccgaccttagtaatatgcccaaccggggattggtccatctgattgattccggcgtaaataactagccggtgattctccaactttaactgcgaaaaaggaatttgaatgccttgcccaatcgcataaacgggttcacccgttgcctgcgcctgctgaatgatggcatcatcagttaagccaccgtaatctaatcggacaatgttcgccgcttgtagttgatcaacgatttgatgcacattctcctgttcagcacgtgaagtcttcaccgtggcgggcaacaattcctgcccatcaaaaataccgttcgcaggaatgtatggttgttgctgactttgttgtgcttgtttttcagctgctaacgcttctttaggcttaccacccaacaatttttcaatacgtggtgataagtcatacttcgcagttttattagtaaaataataaatgacgtttaacgtaatgaaataaatcagcgccaagaaaacgagcatatataagatgccccgtaaccacgcgccattctgcatcaagcgaattgccacataaccgaggtataaattacccgcaattccaatgccgatatagatttggttcttaatcttcacattgacattaacgtaacccaaggcgtggttgatcatatctaaaatactaaacattcgttattcgcccccgtcgctagtagtggtatccgttgtcgactgtgacgttgtcgttgtcgagcttgacgcggtcgtacttgatgactcagcagcagagctttcatcatcgtcactcgtatcagtcgttgaactattgttatcagtcgtactactattagtggcactagaactcgtatcatcagctgaacttgatgaactactggtcttattagcactgctgctgtccgtatcattctcgtcagtactactactggaactactattctgttcatcattagatgtatctgaactggatttgtctttggatttattctcatcgctactatcatcagccgctttctttttcagacttgcggaactagctgatgaacttttgaccacactgctagtggccttggcgccattgacagtatgggttgtcttattaacgaccacgttagttgcccccagtgcaaggacaattgaaacaattgcaaatggtgaaataaatggtggtgttcgataagccatcgatgtcattcccttctgaggctttgccgttattctttctaatctataattaaaccatgctcgtgttcggaatgcactaattctatcacaaattaagaaactctttactcaaacaaggccaacaaaaaagccgactccccgtcagctattaattgcctgctttttcgtgcaattggcacatagaccgtaaatctcgatgcggtgacccgtaatcgtacaacccggtaattgtgcttcatactcgtctaacggacacgcttgcagttccgtcaccttaccacagtttgaacaaacaaaatggtgatggtgttgatgcttgaaatcacattgatatttaaccagggtttgattagcctgggccttcaattccaataatcctaacgtttcaaactctttaatattgcgataaatggtattgtgactcattcctgcaaataaggtccgcatgtgctcatcaacggccgaaattgccacatagtggtcctgataggtcaccagataatctaataatgcctgccgttgcttcgtaattttaaactgattgcgacgtaaaattgcgacggcttgttcaattggtgtttccataatgttgctgcctcctactgaccaggacttcactaaatcataatcattactatttagtttagcatactcaagtgtaaaagtgaattacgttgaccgtctatacgtcagcgctaatctttcgtcacaacatcatgctgacaatattcagtgaccagctcatctagttggcgccgcgtcgcctgccaatcatcattcacgataacatgtgcatgccccactaatcctactggcaaagcctggtcccgcaaatactcatcactagcaactcgcttttttatccggctaggaagatctcctcgcttggtcaaacgctgaattagcgcctcttgatcagcaacctcgagataaatcaccaccgcttgttcgcccaactcccgcgcataggtaatagcccccgccgtatctaagacgatactaatcagtggtgaccgttcccaggctgccgctagtccttctcgtgaagaaccgtattgattaccactataggtcacgtgttctaaataatgtttcgtgacaaaactcgccggagtttcaaaataatagtcgcgcccactgacttcaccttcccggggagcccgggtcgtatgagtaatcacctgaggaatttggtattgtgaccgcaagtaatgactgacagtggtcttaccactccccgttggtcccgtgatcacaaagatccgtttcgttgtcaaagttgataaacctccattttttaattcatgtaaagcttttcatttgcgttagctcggtaaaccgagtatagtaacgtacctataaggttcaaatagatgattcacgcatctcgtagcaaaccaacaattttcagaagggagttttgtcatatgcaatttcaaaaaacaaatagctggttcagcattgtcttagatacgcaacgccaaatgtttgtcgcaactgacaaacttcatccagaattgttcgctgaaggcgtaacaatcgaagatgcagttgcaaacttacaaacccaggcctaagccaatctaaaaatattgtttaaaaattactggtaccgtttatgcgacggcaccagtaatttttttacagtcagtattattgtagatgctgctcaatgtaggtgttagcctgatctaacatttgctttaaattatcgtaagtcaatcgttcgcgggcagcagcataatcaaaccagccaattgcactgatttcagcttgctgccgcgtcactacaacaccacttggaacttcactgacaaacagtgtgacttgcttcaaattaccattcggtaagtcatattcggtatacgccttaaaattggtatcgagtgtcgcttcaatttgagtttcctcacggatttcacgtcgcgccgcctcagctaacgtttcattgccttcaacgtgccccttcggaaagccccaaaaatcactggtcgcactctgtaataataaataagcgggatgaccatctttttgttgatagacgaccgcaccactagctacttctgtactcatgaagtcgcaccttcctaattatgaattatgctctagtataacatgttccatcatcaattgagggctaaaattgcctggagcaagtcccccagtgcgaccccttgccggtcatccgttcgattttgtgcaatcgtttctgctactgccatattcaaccactgattagcgcgcgccagcgttggtgctaacgggtaaccccggcccaacagtcccgcgattacagcagctaaagtatcaccggtaccattataatgccccggcaaacgtcgcgcaccacagtattgcacgtgcccagcttcatccaaccaggcacaaccaatctgatcagcacgttggacatccgtaatgactgcgtgggcgccagtttttaactgtgcttgcagtgctggcaaaataacttctaaatctggtgtcacttgatagggcgctcccgttagcaatgcggcctccgtcgtgtttggcaaaatcacatccgcctgttgaataagctgacgcattgccgcgacatagtcctgatcaaagccctgatagagttgaccgagatcgccgagtactgggtcaacaactaatagcgacagcgtttgttgttctaagtaagtagttatctgttggcacagtgcgaccgaaccaacgtagccgatcagggcttgatcaaaatgcagttgtgcacgggtccaatgcgcaaagacctgtggcagccacgtcgataagtcgacaacggctggtgtcccgtacccgctagtatgtgtcgataataagctggtcggcagtgctgccacgtcatactgcatcgccgttaatacgggcaacgctgaactaagtgagattccaccgactgcggataaatcttccgccactaatattgttgacaatcttgctaccccctcttatctcgtgtaatgcttattctatcagaactccgactgactgtaacctcttcgcttcaaaagaaaggttaaatcaaccactcaaattggcattgattactcctcactgcaaaccgcaacggtattgtcatcattaagcttgattagtgacgactcaaaaagttgagcagcggattgccagtcccgttgttcaactcattaaaatttatcatccatcctcatcagactaagcacacattacgtcgaagcccttcgacacttaaccgacttcagttccttcaaatattatccacaatattagctagcctacaatttgctagtgaatcctaacgtgggcatccgacagtttcagttatcagatgacgttaaatattgctgttccatagcgtgccgggcccgaaccgcatcttcaaaatgcgcaaaatgtttgtttaatatgtacgttcctttgtagtagaagtgcgcaacccaggaacctgactgtttgtcatagctcacgcccacgaccccactcgtgttacgcttcgacttcttgattgaactcacatctgtatggtgatcacgaatcttcaaattgcgcgggtcccccatatgcgaaactgcttgcggattattaaaaatattttgccgactctgttccacggctagacagccacaactacgcgtcttgccgtgccgcaaaacgtaggaatccaccacgcacgtccggccacactgacactgacaaaaccagagcgcattaccattcttggcccggcccgctcggtgaacagctattaagcgtccgaagtgctgaccggtaatatcaatcgccgctcccatcctaatcccaccattctaaaattaaatttctattgataacaatattataagctttggcgaatccaattaacagtttaatgtattatccgtgtgtattctttgactaccgttcgttataacaaagtatcaacttataaataacaatagtaacagctacccaaccgcatattcagacccgtttctcttcagcttagcaccgttaccgccggcttaagtgatgactagtaattcggccatcacaacgctttttaaatccccaccatgactggttacgcgttatcgtcatcaaatctattgtcagcacgaacattgcctcgacagtcgcaatgtcaccagcttctatgatgattaaccagctatcttgcttcgtatcccattgagttattaataataaaaggctgattctaattgacttttaataatcaaccacggtatcatattgacatgacgatttgtcgataatgacaactaactgttacaaataaccaaaaaggtggtccatgttatggggattttccagcgcattttccaaaaagaagatttggagcgctatttacaaaaagatagtcattttgaacgaaccctctccgcagtcgatctgattgcacttgggattggtgccgtcattgggaccgggattttcatcctacccggaacggttgccgcaacaaaagcgggacccgggattattttatctttcgttttggctgccattgtgtgtgccgtcgccgcaatgtgttacgccgagtttgcttcggtgctcccaatcgccggttccgcgtattcatacggaaacattgtctatggcgaaatgattggttggatcattggttgggctctggtactcgaatacgtcctagccgttgcgaccgttgccgttgggtgggccgcgtactttaattcattcattgctggttttggcctcaagttaccgaaagccatcaccggttcgtttgaccccgcccacgggacctatatcaacgtgatcgcaattctgattgtctgtctgattgcttggattatcgataccggcctaaaaacgtcgattcgattaaacaatattattgtggtcgtaaaattagcaatcattgtattgttcttattagtcggttcattttatgttaaaccaagtaactggacaccctttgccccatttggtgggacgggaattctcaagggcgccgcggtcgtcttcttcgcttacttagggtttgatgctgtgtcttcgtcggcagccgaagttaaaaatgccaagcgcaacatgccaattggaatcattgggaccctagtcatctgtaccatcttctacattctcgtttcaggagtgctgaccgggatggtttcgtacaaacagttgaacgttgacgatgcagtggcgttcgctttacaactcgtccatcaaaacttcgttgccggtattatctcgattggtgccctcgccggcatgttcacaatgatggttacgatgatctacagtagctcacggctattatattcaatcggccgtgacggcttactcccacgtttcttaggtaaaatcgataagcaccacgcccctaaaaacgccatgttgacggttacaatcgtgatttcaattcttgctggtctcattccgttagaccaattggcaaacttggttaatatcgggacattaattgccttcgccttcgtttcttttggaattttgctactacggcgtaatcccaagctcaacgcgatcaagggcttccgcgtgccactttacccggttctcccaattatttctggcttgctgtgcctgttcatgatgacccagctatccatggaaacttggctggcatccctagtctggttcctccttggtctcatcatttactttggctatggcattcggcatagtcgcatgaataaagctgatgagtaacaatctagatttgtactaactaaaagcgcccatctcaagtgatcaatcaacttgagatgggcgctttaactattgtcagccagctaacgatgacaacgattacattttaaggtatgataatgatacttaattaaggagcgtggtttaatcatgttaacacctaaaacgatccatgacgaccttcatgagcatcatacccaggtcgttcaactattcagtaagcatccctggctcattcccgccacaaccttattacacattattccagttgtcgtcggcatcaacggcttttggaaatcgcgagcactaagcaagcagctcaaaatcgaacgcgaaaaaacgaagcaacttgccctacaacaggtcgataaagttcagtcagcagttactagtcagcacccaagtttacgccaacttttcaagcaaattcgcagtcatcattaacaccaacgtggttcgaattggcagttttaatcgctgccaactcgaaccacgttttaatcaatcccctgacatttttacaaactacgattaatgattactgcggccatatcacaacggttaagccaattgaatcgtcaagttggctgatggcccaacgagcttggcaacgggacaacgcgtttccgcaatcgcgagccaccgtgctgccgtttcagcatccacttccggaatcgtgacccgagcatctaggaaaaattggtacccaaaacggtcacgcgacatcttcaccgtagtcacgactttgctctgatgtgtctggccgtgctccttttcgattgcctccagcgtcgcgttaaggcatgtactgagcgccaatccgattaattgttccggattcgagcccggcaccgccttaagtggactagatacggccacctcaagaccattgggaatataggcgtgtccttcgatgccgtcttcattaactgcttgggtcgtatataaaattggaaaatcactcaatcttagttcctccattcaatagttcactttgcaattaacctaccacaacattataaacttgtcagtaagaagcattggttctcgactaattagcggtataatatttctaataatacttaatggggaatttacttatgaaaaataatcaatttgcaatcgtcccgactgattcggaaaccgcgattgccgaacttacgaaaattcattttattacgcctgatatggacgccctgacgactgttccagccgtctaccaggcattgctagctaaaagcttaccagaagtccacacggcaagcggcttgacccacaagtttaataacatcatggcaaccagccagcacactttatcagaatggctcgccgatgcaactatcgtgaacaatcaagtcttttataatgtgggacttcagttactgggttttctacctggtcaagattttgaattggccgatccattgctggcgatgcgcgatattcacttgccaatggtcggtgatagcgcctttgatcgtgaagccctctattatgcttggtacctattattaaatacacgtgggaataatggacaaaccttgattgaatcactcacgacccggggttactttgtaccattttaccaattacctaacgatcaaaagccactcttcttcaatggtaaggcccaagccgtctttgataccaacgcgctcattcgtgacgtcgtctacgttgaagcgcctttagatactgaccacgacggccaacgggacctgctcaaagttgaaatccttcggccagctgagaccgaaaccggcttaaaagttcccgttctctataccgctagtccttataatcagggcatcaacgaccaagctggcgatgctcaaatgcacaacgtagacgttcccctgactgcaaaggaaccggacgaaaatacctatgcggatgttgagttccagccaacaacggcgcaactatcagccgctcgaaccgcgaccacgacgaccgatacagcagaggagactttcagccgagaaaagtcctacacgctcaatgattactttctagcgcgcggttttgctgtcgtctatgcagctggaattggttcgatcgactcggatgggctagcccctaccggtgacgttgatgaaacgacctcaacagttgcaattattgaatggttgactggcaaacgccaagccttcaccaatcgtgatggcaatatcgctatcaaagcttggtggtgcaacggcgccgttgctatgactggccggtcttacctcggtaccctcgcaactgccgctgctacgacgggcgtggctggccttaagacgattatttccgaggccgccatctcaagctggtacgactattatcgagataatggcctggttgtcgctcccgatacgttccagggcgaagacaccgatgttctcgccgctgaggtcttctcacgaagcttaaaagccggtgacgctcaccagatccaacccgcgtttgatcagaaactggcagaactgactgccgaccaagaccgagcaagcggtaactataaccgtttctgggatgaacgcaattatctcaagaacgttgacaaaattaaggcggacatcatcatggttcacgggctcaacgactggaacgttaagccccgcaacgtagctaatttatgggataaattacaggcagttcccgttactaaaaagctcattttgcaccagggacaacatatttatatcaataacttacaatcgctcgatttcaccgacatgatgaacttgtggctaagccataaattatatggtttagataatcatgcggagacactcttgcctaacgtcttggtacaagacaacacgcaagcccaaacttggcacggctatgacaattggtggcaagacacaaccgacgccttagattttaaggttcagtacaaagaattagttcctgctgaccatacagttgaccaacgcgccgctcattttactgataaattgcctgacaaattattcgaccactataagcatcatttggatagttggcagcgcgacctcttgcaagaggataagttaaatccgctctatgatcaccgcctcttgttcaagtcttggcaggcacctgaggatcaattattagtgggtattccgcacgttgcgggctctgtcgccgttaataagaatttcggcatgttgagctttatgctgattgacttcggggccgcgcgccgtttgactgtcagcccacaaatgctggctgcaaaagcgcttgatctaggttaccactggcgcgaagatgatttgaaggacttcaagttagcgggtgagacgccgttcaagatgattactaaggggcatcttaacttacagaaccgccaccacccatggcacgcagaagcgattcagccaaatgtcttttatgacttttctgtggatctccaaccgctgttccaccacttgctgaaggggcatcaactcggactagtcatttacgcaactgatatgaagatgacgattcgtggcaatcaagacctacagtactcacttaacttgaacgatattcgcttacacgtcccaatgaaaaaaataacagactaactaattatggcctaccaactaaccacacaaccgttaactggtgggccttttgtgtaccttcaacttaaacagccacttatcatgaccaggtcggacaccaccacctgtccggaactagccaaaaaaagttccagcttaccatcaacgtaagctggaactcatctttaattgttattaacttcggcaatgcggttcgcaatcaaattcgttaactggcgattaccagtcgtatttggatgaacattgtcatctgcaaaccaaccactttgattctgcgcacgaccatgccaatcgataacatgcacgttcgcatgcttcttagcagtcttggcaatttgagcattgacctgattttgccaactctgtgttgggacgtgggccgttacccagaaaatctgacgatccttaccaatcagcttaacgacttgttcagcttgatcatccgtaattgtcccgttagtcccaatgttcaataggacgttatgggctaattgcccttgcgacttcagcgaattaatgattccaggaacttccgtcacttgacgaccaacgcgaccttgaaccaccgtacccgggataacatcttgaagatcggaagaaacatccagtaacaccgaatccccaatggctgtcagatccgtattggccatcgctagaacaacttgtggcttcaaatcgtattccttttccacctgcttctgcttcgagttcaacttcgcttcagcctgcttggtctgcatcttttcagtcgcaaccttcttgcttgaagcagccgctgcctgggcagctttttgccgtttgagcgccgccgcattcttcttatcagccgctttagagttagctgcaatcgtcttttgtaattcagtcttcttgttagcttccgctttacttggctgttgaacgaaaccaaccgccgtaataacgaataagaccgtggtcaaagcgacaatcgcagtggtcacgcggttaaacttcggtttgcggaggaaatctttgaagtcgaccaataaccgactgtaatcatagtgccgcattggattttcaataaaccgataactcaattccgtcacgatcaaaattaaggcaacttcaatcaaactattgaggagtaaatgatcaccaatgtttttaactttagtttcgtagaaaatcatcactgggaactggtagagatagatcccataactacgttgcccaacgtacttaaacaccggattcgtcaagacgcgattgagatgactagccgggtgggccaccgttgcaactaacactgttgataggactgtgaatagtaacataccgccacgataagtgaaatcagattgaccggacatctggaaaaacatccaaataattgcaattagcgaagcaccgcctaagatatccagtgtcactcgattaacattagcaatgtccgccgataattcccgtgatggccagataaacgcaaggccagaacctaacaagattgcaaacatccgcgtatcagttccgtagtacacccgattcgtattcgctggatcatacaacattgccatggttatcgctgaaatacccgcagcaatcatcataaaccagaagacccgtgaacgcttcttgaagatgaccatcaagataccaatcactaatggccagaataagtaatattgtccttcaattgagagcgaccataaatgagtgaacggtgattcaccattgaaacggtcaaaataactttgaccgtgattgatttcaaaccaattatagacgtagactaaattcgttaatacagtagcccgaatgttcgtcaataatgaccgttgaaacagcgtaatgtaggctgttgtccctaacaacatcgtcacgaatgctggatatagccgccgcatccggtgtccgagaaaccgccatatccggacatgcccccgactcaaaatatcttgtaataaaatatccgtaatcaaataacctgaaacgacgaagaagatcggaactcccaagtaacctccttgtagtgaggccggcatcaagtgatagatgatgacacccagcaccgccaatgtccggataccatcaaatccggtgatataacgtcttggattcatccggtgtcgattcatccgactcattgttcggctcatatttacgctccgcaaattttcattcatattcctattaccccttgaattgtctctacaaatattaactaacccaccagtgcttcggtacctttactataatatgtaaatgaccgcattgaccagcattatttaaacttcattaattatttttattaaccactttattcattatgctgattaaacacatataaccccgaacttaattacaatataaataaatcaaacgtgagtctattaatccatccgttatcattcctatgttatcaacaatttaaggttgattcgacgtaccaaacagctcaattaatcaaattgaaattgattagcactacttgtgactaacttctactatacaacagtatgaaccagtaaaacattgaatcagaaatcattttaaaagattgacgcgattcgttcggtaacttgataaattgattttacaaacttgctagccatgataaccaccggacaagaggttcaccttagtaatctcaccagaactaaaatgacgactctgaccagtctctaatttgacgactaacgccccgtgtgcatcaatatccgtgacaactccacgatacttttgcgttccgctcttcaactcgacctgttgatcgatcaccatggagagtttccgataagcgtccatgaaagtcccactacgataagtcccatagctattgaaaaagcgccgcagtagctcacaaatcacttgattgcgcgtcacaccatttggattggcaacgactgcgcccgctttgtgcgctagtagcgctggaaaagctgtcgttgttaagttaatgccaattccaataatgactgctgaaatttgccccgtttcgagactagtgatgccttctgataagataccaaccaccttgtgatgattgactaacacatcattgacccactttaatgaaacgtcaaccgcaaacagctgttgcagcgtctgagcaacgactaccgcagtactcgttgtcaacaaaccagcgtctaacgccttctggtcactgagtggtaacccaatgctcatgtaaattccagtctgtgctggcgaataaaatgcccgccccgaccgaccgtaaccagcagtttgcgtatccgcaaccacgattttcggaagtgctaaaggcgtctgcgtgactaaccgccgtaaataggcattcgttgaatcaaccgttggtagcacggtcaaatcaaacggtggtaacgctgtaagcgcgtattcaatcaccggcgcactcaattgattattggccacataccgataacctcgcccatgccggctctcaatagtatggcccgccgcttgcaatccttgcactaatttccaaatagccgttcgactgattgcaagtcgttgtgccaaccagtcacccgaacagtacgcgggcgccgcttggattaacaagcgtaaaactgcgacttgatttgccatatcaatctcacccatctctaattagttaacccattatttcatattggttaactaaccgcaattgaatttaaagaatgtaatattacatctttctgtgctgagcagtttacttattatcgctgaaaatgtaaccgcttgtcaaatcaattgtgtacaatcggtcacaatacgactgaaacttggtctatcagtcgtaccgaccagcataataactagtataaaccaaattcagactaaacggcccgttctaattattatttttatatcgtttcgaccgaattcccctcccatgctcagctactatgacgcgaccgtactgattcagttaattagcgaacacgaccttaccaattatctacttaatgcaattctttatgattgcctagtctctttgaccctgcttagttaacagtggtaagataacaattaaaatatgaagaaattaggtgatcatttgaaacaaggaacgacaatcatcacgctggataatggctaccatttatggacgaatactcagggcaaaggcgacattcaattattatgtctacacggtggccctggtggcaatcacgaatactgggaaaactttggtgaggaactggcagatttaggcgtccaagtttcaatgtacgaccaattaggatcctggtattcggatcaacccgactactcagatcctgaaattgctaagaaatatctcacctacgactacttcttagatgaagttgaagaagtccgacaaaaactaggactcgataacttctacttgattggtcagtcttggggcggtgccctcacaatgatgtacgcgctcaagtatggtcaacacttaaaaggcgccattatttcaagtatggtagataacattgaggaatacgttgtcaacgttaacaagtgtcgtgaagaagccctaccggctgacgctgttgcttacatgaagcaaaaggaagcggaaggcaactggaatgatccccaatatcagaagtacgtggacgttctgaacgctggctatgttgaccgcaaacaacccacttcaattcgccatttgatcaacaccactgccactcctgtatacaacgcctttcaaggtgataatgaattcgttatcactgggaagttaaaggaatgggatattcgcgatcagattcacaacattaaagtgccgaccctgttaactttcggtgaacacgaaacaatgccattagcttcggcccgccgcatggctcgtgatattcctaactcacgcttagtaacgacgccaaatggtggtcatcaccacatgatcgacaatgcccccgtctactttgaccatttgaaacaattcattcgtgacgtggaagatggcagctttaatcaaaaataaatcctaactgaacaattaagaagccgccagtatcaggtcatacccgatactggcggcttcttaataatattaggttaactgaagctttgcccagtggtctaactagcccttcaggctttaactatagctgatcaccctgtgctcgtagtaaggcgcctaatgatggctgttccttaatatcaatgtggttggctttggcataagcgtcaacttctgcttgaccatataattcaggatctagtggcatgtaagctgtgccaattggatcatcattcttgatgaccgcgttcacaacgattggccgcttgttgcccttcgcttggagcgccttgatttggtcaaagacggtttcgacctcttgattattttgaacagtaaaaccaatcccaccaaggccatctgcaactttggcccagtcggcatccgttagatcaacaccatacaagtgttgcttcgtatcaacttgctcacgatagatgaaaccaaaccgttgattactgaaaatcacgttaataacgggcaagccgtaacgtgcttccgtgataatatctggcgctaccatcgcaaagccaccatcgcctgagaaactccacgcttggctgtctggaacacttaaggcaccagccatcccagcaggtagtccaaatcccatggttgcgaagaggccagataaggcaaagcgttgctcctgatccattgggagcccccggacagcccattcggagacgttaccggtgtcgaccccgtaggtatcacgagggccgaccatactagcaactttgtgcatgaccgcttccggcgctagtccatcatggtcgtcagcagccaattgttggagccacttatcccaattacgtttattttgccggttagtcgttaaccacgctgtttcaggtaacgtttcgccagttgcaatcatcgcttgcaaataagcttgggcgtcactgatgacggcgtaatcgattgggactatcttgccgatatcaaaactgttattgttgacctgaataatcttaatccccttaggccaaaaactagcaaatggaaattcagatcccaggaacaaaatcaaatcagcgtgttggagtgcttcgaaccccgatttggaacccaaccggccaaacgtgccaattgcattcgggtggttcgttggaataacccccgtcgccgggaccgtattcatgactggaatattgaattgttcactaaacttgaccaggtctgccttagcaccaagaagaccccgaccagcgtaaactaatggatgcttagctgcttttagcatctttaacgttgccgtaatggcctgaggatcgacccgttgttcaaacgtatctgaaacggtgttaggcgtcgataccggctgataatcgatttcttccgctgagagattttcaggaatgataacgactgccggtcccttttgccggtatgcttcacgaatcgcttggttaatgacatatggtaattgtccggccgtcgtgacagtgcggttatataccgccacgtcactaaacattggggtctcatccatttcttggaagtaattcgtgttcatcgtcgcttgtggtacctgtccgacaagtgctaatacaggaacgtgatccatcttggcatcatacaaaccgttgaataagtgcgttgcaccaggacccgcagaaccaaatgaaacgccgattttgcccgtaaacttggcatctgccgaggctgctaaggcccccacttcttcatgccgtacttgaatataatcaatatcggccttttcaaggtacaaaccttcaacggtatgattgattgaaccgccgggaatcccgtagatgtggtccacaccccacgcctctaaaaccttaactaaagcttgtcctgcaatcatctttgtcatcactattcatcccttcgacttagaaccaatttgtctgcttggttcaattcatttaacaaacgtattataaatcgctttcaattataaatgcaattaatatgcttacttttcgtaagtgaaattacaagtacacaaaacggggcaccattcagcgccaattttgtgtttatccgattatttcatgtgaaactatctatggactagaaaaataggatcaagcacacacccgatactcagttttatcaaatatcgctaacaatctagcacgaacaacttaccgacgtgacgacaatcaaaaaccaccccatcaaacaaatcagggtggtctacattaagctttactatattgtgattgttgatgctgggctgagacagaactgaccacttgcaaagcacgctgctgccactgaacgtccacatctaataccgaggtttccggtggcaactggtatggcgaaataatttttaatgtcgtggtgactcgcagaatgactgcctgtcgataattagcgctaactaaccaacaacgataatcaccggccgctggtaactgctgttgccgatttgcaagttggatcgttctagtcaacggatcgaatgtcgcctgtgtcgcgtaagtgtaccccaataaatcattagcttgttcaatctgcccccgagcaatcagcccccggatccgagtagaactgactttaagctgctgattagccaagcgatccaccgtgaccgtttcaaagtacggggcgcccaattccgcgagttcgcgcatcccatttgtgccaccctgcccgaacgtatagtcaaaccccgccacaacgacttgcgcattcaacccgacaaggtaatccttaataaacgcagtcggtgtcaagccagcaaattggtggttaaaatccgtaatatatagtcggtccacctgtagcgccgccatatgttggcttttttgcgcgacggtattcagataccgaaaagtggtctgggacttaaacagttgtgacgcgtgtcgattgaacgtcatcacagcgagtggtaaatcacgctgcttcgcaattcgtttcgctgtttgaatcacgcgttggtggccctgatgcacaccatcaaagaaacctaaagctaataccagtggcggttgtggtgccagcatctttaatcgatgggcatctaaattgattacttgcatctgtgcgacctcccgaacgttcacgtagtgttctctacagcttggtatgttgtcaccgccacaatggcaagcgacacttaatactatgtaccaaaagagccgcgataatcgcgtcctctttcgttaattatctatccaaattagtttgtttgagcttgttttaagaagtagctgaacggcttcaacgcttgagcatcatacttcttgacaaattcagcaatcttgtctttatcttgccatgcgtcatcgagatacatatgttccgttgtaaatggcattgcatgcgttaacttcacatcaatgacaactggcttatccgtcttcttagcgtcttcaagggcttgcttgaattcagccttggtccgaacggtataaccaacggcaccatagccttcgccaaccttggcccaatcagtatctggcaaatcgacaccagagagtggttgatggctatcatcagtctgttcagcttcaataaagcctaaggtctcattactgaagacaatgttgataatgtgcaagttatacttaacttgtgccaagatttcttctgacagcattgcgaaagcgccgtcaccgctcaaactgtagacgtcccgatctgggtagttgactttagcagccagtgcagcaggaaccccaaagcccattgttgcataaatcccagaagttgcccatttctggtcatcgtgcattcggatcaagcgttcaaagttaatattaacattgccgacatcgatagcccaaacagctttgtcactagcttcttggttcaagacatcaaagattggttcggggcgaactggtgattcagtgctatcgttgaagctggcttgccatttgtcccagttctttttatcagcaaccgcagcgtcataaaaggctgaatcatcgcgcgcttcaccagctgcattgatcgccgctaaagcttttttcgcatccgcctgaatagcaacgttcgtatggtggcgcttaccaaatttttcactatcaatatcgatttgaatgaccttagccttcttattaaataagaagatactgaatggaacattgttaccaacccagagaattagatccgtactaaagccaatctcggcacccggcttaggtgcgacccgtcccgtggaacctaagtaagcgggatagtcgtcttcaatgatccccttcgctaatactgaagagacaagtggcatcttaaacttttcagaagcagcttttaattcttcagccgcgtccttagcgccaacgccaaagtaaatcattggtgacttagcagctttgattaatttaaccgcatcagcaactgattcagcggttggtgcaggatagttaacagtgtgcacgctagcgttcgtttcaaagttgtcttcaatttcagcccaaccaaagtccttagggatcgttaagacagctacaccattgtgagcatacgcttgacgaatggcttcatcagtcatcatcggtaaactctcagcagtcatcgcagtccgattccaaacagcgacatcgtcaaaaatcggttcttcattcattgcttggaagaagtccatgttcatccgcttagtaggaacttgtgcaacgattgctaacattggaataccatcttccttagcatcgtacaatccgttcagtaagtggacagcaccagggccagcggaaccaaagcagacgccgatctttccagttagcttataatcagcggaagcggcaatcgcaccagcttcttcgtgacgtacttggatgtacttcaacgtttcccgttgattatagatggcgttcatcgttgaatcgaacgacccaccgggcaaaccataaatatgttttacgccccacttctgaattacttttaatacggcatctgaaccactaattttagccattagtaatgtcctcctctgatatattttaattatcaactttacgactttattgtaatcacgaatttttaaaatgtaaacgcttttatcgatagattttatctatcattgaaaatttcgcgaaactttctatggtttacaagcgttaacgacgggctttggagcgtttttaatttttacaaaaaaacgtatttttttgtatttttatattttgtattattttcgacaccggtataccaccttaaccaccgtactaattgtgtatttgtcttattaaatcgaattggtacgggtacatccccactcgttacgcttgccccgcttagcaaatctcggccgattgactgctcatgagctagtttcaagatagtttttgatgacgacgcttacatttcaatgtttatcctaactttctgattatttcaccttccccttctatcacttgaataactctagtatagtcacctccagagcaaaccaacttgatgctcatcaagttttagcccatttcacgtcaaaaaagactaccaacgtcatgtgcgtcagtagtccgtttagaattaagtcatttaaattatctgtaactggccaataacgtcgagctgaccatctttaactgtcagacatttaatatccacaagaagataatgaagatgaagaacagcacgtacattaatggatgaacttccttggcatgcttagttgcgaccatcgtaatgacgtatgcaatgaagcctaaggcaatcccatcagaaatactataagtcaacggcatcccgataacagttagaaatgcgggtacggcaatttcaaaccgttcccaactgatctgttttaaagattctgccatcaacacacccacaataatcaatgcaggtgcagtaacttgatccgtcacgacgtttaataacggtgagaaaaataatccaagaatgaatagcgcaccagtaacaactgcactcatcccagagcgaccaccgaccgcaattccggccgaagattcaacataagctgaggttggtgaggttcccaacactgacccaactaacatcgaagttgaatcggccatcagcgctttaccaacccgcggcattttattatttttcatgaatccagcctgttctgccaatccaactagcgttccggccgtatcgaagaatgtcactaataagaacgtcaaaacaacaataatcaattgtaacgaattaatatcaccaatatgaccaagcgccacaccaaacgttggtttcaacgaaggtgctgccgaaacaattgtggatggcatcttaatcaagccagttgctagccctaaaatggaggttaaaaccatcccgataaaaatcccaccgggaactttgcgactcatcaaaatcaacgtgacgatcaatccaaaaatagttaaccaggtcgttccaactgtcaatgatcccagaccaacaaccgttgatttgttggcaacaattaagccaccaccatgaagaccaataaaagcaatgaagaacccgatccccgccgaaattgctaacttcatatcccgcggaatcgcatcaataatcatttcccggagcttaaaaatcgtaatcaagataaaaatcacggctgcaacgaacaccccagccagagcagtttgccatttaatgcccattccgataactacggaataagtaaagaacgcgttaacgcctaatcctggtgcaattgctatcgggtacttagcaactaaccccatcaataaacagcctaacgctgacgctaaggccgtcgcggtgaagacggcgcccttatccatccccgaagccccgaggacgctcggattaacaaataggatgtatgccatcgaaacaaacgtggtcaagccagccagcacttcggttcgcattgacgttttcaattctgaaaaattaaaatatgccgcaattttattcatgattccctccaaatattcgtctaaattataattgcacaattgtaaacgttcgtgttttagcgttcttttaacgtatttaatcgtatcattttgtttatttaaaagcaataaccgaacgctaaataattttgaatctgtttaattgcgattttcaattttaatgagcctgcggtagaatgaaattgataaagcgtgttcattgccttaaaaccgctcttggtcctcacgaccctcaggcaaacaacgcgtcacgattctccatacaaaggtgtgatttaaatggctggttccaaaattacggcaatcttctttttaatcctctacgctgtcctactctacttggtcttcacaatgcagaacatgttagccatgtacttaatggctattgggatgtttcttgaagcttgcgaaggggtttaccataacttcttcaagcattgagcgccacacgtatcacagtgaagcaattacgcccatttgagtgcctactttctatgaaacgaccctactttagtacaagtgtttttattcaatgggtattcgtaacaaaacagacttcttaagaattgtgacaattcctaagaagtctgtttttgactagcgaccaaaatagttgctcatcaatactaatttagtggttagtctcatgtacatcctagtgtagaacggggtgtgactgtggctcaccgaggtccgtgacctgctggctaaaggtccccatcatcttgagcacttgatcaatctgtggtgcgcccaactggttgacccagtgatcaaagtgctgggtaatggcttggtcgacaatccgttcgacttgttgtccccgttctgttaaatgtaagtagagccgccgccgatcacgcggatctggcacctgaaaaacatagtgttgcattaacaatgatttgacttgccgtgaaatcgcgcttcgcgttacttgtcgctgaattgcaatatcattgagtgtcacttcatcagtcgtggcaatgcgccgcaatattaaaaattgttcaaatgacagtttattttgacttaaaggccaagccactaagtccatcataattttggttgtattttgatatgcttcaaaataatcattgagaagtttgcttaattcgtcactgttcatcgcgatcaccatcacttcattaacttttgaccaaatataacacgcctttaactgttttgcatgaaattacccgtaaattccaacgttaagcatcctccctaacaattttgtgcaacaaagtgtatgatgaaagtagttgaaacgcttacgcaaaaaggagacgagaccatgcccctgacacccttacaccaagttgaattgcgcttgatgcgtaccgtcatcgcaatctgtgaggctgaaaatatcgattactttttgatcggtggttctttactcggtgctattcgtcatcacggatttattccgtgggacgatgacatcgacattggaatgcgccgtcatgactaccagcgctttatcgccgtcgccaaccaccatcttgatccaaacaagtttttcctacaaaccggtgcctcagatccggactatgcactcagttatatgaagctattagatgtaaatacttacattgaagaacgcaacaacgtcaataatgcgtttaaaggcgtgttcgttgacatctttccgtttgataagattccagatgacgaagccttacgtcgttcacagatgttacattacaaattagcagacgctgcgatcctgctcaaattgaattaccgctttgtcaaaacaccactgcgcaacttgattacgaaacacacacctcagcaattagctgaagtcaatcgctataagctggaacgtgaggaatacatgcgcctgtacgagcagtcagactcccgaacttacaaaaatctggcgtctcaatacgattacgaaaaggaaattatgacctatcaggaattgaccgagctaacgaccgttccattcgaagatatccaagtgaagattcccagtgcgtatgacaccattttgacccggatgtatggtgattacatgcagctgccaccagctgataaacgagttgaaaaacatctgaacaaactaattatcgataatcacgaaatcttataatatcaactagcgtggttcaagcatactcgttacggctgaaccacgccttttttgtatcttggatcaaacgtgccaagttaggttagcgttcgctaccgctgaaaccggggtaatcaccacatcaaccacctaactagtaagattcatacaaagttaatgatggccttaattacgcttaactttcgtataaaaactaaaagtaatcgctaactgtttcactactaaaatactaatttaactaaccccaacctgtgttaaacttaaattaaatacatgactttaaccttattgggggtcaggaaatcataaaaatgggggatcgccatggcagcaaaattatttggaattatgatgattaacgttcagagtattgaattgtcgattgtcaatttacgcacattacgccaagtagaacgagttcgttccgacgtttcacttggtgaggatatttatgatcagcatacgatcgattatgattcagtggaacaagccgcgcaggcactgagtggttttgttcagattatgaatgattacggcgttaaggactaccatttatgggggtcgtggtccttgtcatccgctaacaatgccgactatattcaagaccaattacttgtccggactgggctcaagatcgactggttatctagtagtcaggaaacctacctgcgttcagtcgcagttgcggtacactttccacgattcaagcaaatgatcacgaagccgacctacttattaggaatcaactctggtagtgtcggtatttcgcactacgatcagagtaactttgtcttctcccgtagcctccgtttaggaccagttcgaatcgcggaagttcttgaagatttgcaatcgagcgtgcctaactatgtcgaagttttggatgattatatttcgagtcaaatcgttgactttggtcgcttcttgcctgggcgaagagatcagcctagtaacgtcgtcatgctcggcgtcgcgccgtttgccaccctctttcgccaacaacaatcaaaagctggcgtggaggaactcagcaaagcagattttcaagctttatatgaggacgtgttgaacgcttctgaccagtatttaatggataaatacgaagttgatgaagaagacgtgcgcctaatcgtgcccgaattactacttattaacgagttactacaactcactaatgctgagaaaatctggcttggcaacgtgaccgtgctggatgggttaattattcaagaagccattaagttgggctataagaaatataactttaatgatcaaatcgtaacagcagctaagaacattgcggacaggtacaacgttgaacctaagcatcgcgacttggtcaccaaattctcactgcacctgttcgaccagcttaaaccgctacaccacttaggcaaacgcgagcgcttactcttacaagtcgccgccatcgtgcacgacgttgggagctacattgacccgcaccaacattacttacattcggactatatcttgcaggccactgaactcatgggattaaccgataccgaaaaacgaatggtcgccctgatttcacgctaccatagcgcgcaaacaccatcaaaagacattcgccattttggacacttacaagtcgaacaacgcttattagtctccaaactatccgccatcttgagaattgcggacgctttggatgacggtcgcaaacaaaaaattgataaaatttccgtttcaattcgcaatccacgggtcatcattacttgctttgctcatgatgacctcttcttagaaaattgggtattcgcacaaaaagcggaattctttaaagaagtctttggtttaacaccagtgattaaactacggggggtacgttaaatgaattattataaagaaagttattatacaaaccgtgaactcagctggcttgattttaactatcgtgtccttgatgaagcacgtgataaggataaccccttgctagaacgtgtccgttttctcgggatcacacagagtaatcttgacgaattcttcacggtccgggtcgcatcattacgtaaattgatgtcagtcaattacactaaaccggatcccgcgggactgaccgctgctgatcaagtcagtgcaatcagtgataaagcccacgagatggtcaagcgtcaatacaatacattaaaccgctcgcttttgccattgctggaacagcacgcgattcatctcttgtcgatggctgatctaaacgaggaacaacacgcctttgttaagaactactttgatgatgagctgtacccggctttaacaccgatggcagacgactcttcacgcccattcccgttcattgggaataatacactcaacatcgccttacggatttataaaaatggggataagaaggaccgcaagtttgccaccgttcaagtgccggacgtctttcctcgcgtggtcgttttgccaggcgcaccgaaccagtttattctgattgaggaaattatcaaagcctttgtcggctcactatttatcaactacacggtcaaggaaacgagctgttaccgcgtcatgcgggatttggacttagatgtcgccgaagaggatacctcggacttattaaaggaagttcaaaaacaattaaagatgcgtgaacgcggtaaggtcatgcgcttagaagtcgaaaagagtatgagcaagcatcaacgcacgcgactcgctaaagcccttgggattaacgaaagtgcgttatacgtcatcaacggtcccctcaacttgaccttcttatccaagctggtgaaagctgtgcagggccacgaagacttgaattatccaaaataccacgcctactatcccgcgaagtaccgcgaacgatccatctttgatcttatcaaggatcacgacattttaatgcaatatccgtacgatgatttcaaacccgttgtggactttatccatgaagctgcggaagatgaggacgtgttagccattaagatgacgctgtatcgcgtatcagctgattcaccgattatcaagtatctcgggcaggctgcccaaaacggcaaacaagtaaccgttctcgttgaagttaaggcccgttttgatgaagaaaataacgttcactgggcgaaaaaacttgaagaaatgggttgtcacgtgatctacggcctgatcgggcttaagacacactgtaagcttgccctcgttgttcggcgagaaaatgaaggtatcaagcgctacatgcacatgggaactgggaattataacgatgtcaccgcccatttctacacggacatggggctcttcaccgctgatacagacatgggaatcgatgcttccaacatctttaacatgttatctggctattctgaaccaccgtatttccacaaattgcacatctcaccagatggcatccgcgactttatcaacgaaaagctagacgatgagattgccattgccaaagctggtcagcccgcagttgtcaaaatgaagatgaactcattatccgatccgcagattattagcaaactctacgaagcttctcacgccggtgttaagatccaactgatcattcggggaatttgttgtttacgaacaggcatcaaaggcatctcggataacatcgaggtccactcgatcattggtcgccttctggagcacagtcgtatatactactttagcaacgacggtgaaccacaaatttacttatccagtgcggatatgatgacccgtaacctaaatcgccgggtcgaattattgttcccactgctccaacctgaaatcagtcaccgtgcgatgacaatttttgaaacgatgtgggctgacacggtcaaaacgcgcattttgcaaccagataatacgtacgcccgtgtggatgggcgcggcttagaggttttggactcccaggccgaattcattcgcgaagccgagcaagcagtcaaggctgatcacggcgatactacgcccactagcaacgcgcaccagttcattccgatgatgagtcccaagaatgagccggatgcttcagatcttgatagagaggatgattagcgatggaaaactttgcggtcattgacttaggttccaattcatgtcgaatgacaattacacagattcaggaagacggtagttatgcggtcactcaccgactcaaggaaatggtgcgtttatccgagaatgaaaacgccacggatacgccgacccttcaagccgaggccattgaccgcacgattgcagcgctaaagtcgtttgctgccgtctacaaagacttacctaacttaactatcaaggccgtggcgaccgccgcaacgcgaaaggccagcaaccaaaagaaatttctcaaacgcgttaaaaatgatgttggcctagatatcgaagtgattcctggaacaaccgaggcctattacgattacttaggggtagtcaatacgcttccaacgactaactgcgtcatggtcgatactggtggcggtagctgcgaactcgtccttatcgtaaacggccaagccaaggacctaatcagtctgccaatcggcgcggtcagtttatccgaaaagttcggcctcaacgaccaagttaccgctagtcaattatttaaaacgatgactttcgttgataaaatttttaatagcgtctggtggttgcgaaacggtctcaacttaccactcgtctgtttgggtggtagcaaccgaacgttagccaaaattaaccggcgcaaatgcaatatcctcaactttgaagatattcacggttatcggctacgtgacaacgccatctatgacacattcaatactgtcattagccaggatgcagctggtcgcgcggctattcctggattagcaaaggaccgggctgatattattgttggtgggatgattcctgccattagtctgatgcgctttttagattctgaccggatgattttctctcaaaatggactgcgtgaaggcatcctattcgagcacctgactgctttagctgaacaaagcgctaaagtcagcgaataaaaaaatcggactgacatttttatcagtagtatgctaggattaaaacattaataaattcatcaaggtcgtctttgatgcttgtatatctttacaacggaatctccgttggtcaagaaaagcgtcgtttcacatacgaaacgagctggccttgatcaatggaggttttattttgtctacaacaacacctgtcatcccaacccaaacgaaggttgcaatttttggcaccgccagtctggctttttgcggtattttagttgaaacatcaatgaacgttacctttccgaccttgatgcaccaattccacaccactctagcaacggttcaatgggtcaccactgcctatttactcgccgtagccgctaccatggttattacggcgtttattcaacaacgcttccgttggcggacaattattaacgttggcggggctggtttcgttcttggcggtttattatgtacagtcgcgccacagctctggttactactattcggtcgaatcattcaagccatcggaactggattggcattaccattagtatttgcgcaaatcatgacccaggtccctttcactgctcagggtcgttttacggggaccgctggaatgttgatcgcattggccccttcactcggaccaacatatggcggcttagtgacacaactattatcctggcgcttaattttcggcattaccctaccgtttggtctgattgcttggctgataacggccaaaactattcgccaaacgcaggcaccacggtcacgtccgttccccttatgccaattcgggctagtcgtcgcggcactcatcctgctgatttttagcgtcaataaccttagtacacatggcttaagcttagtattcgtctggttaccactgttattagcggtactcgccgtactgacttttacccgttcggcaacccgaaccatgcacccactaatcaacctggccgtcttccaacagggtgactttacccgggcgcttctcatttacttcttcattcaattcattcagattggactgacctttctgctccctaattttgcacaactcgctttgggtaaaaatgcgttagtgtcgggcttaatgctattagcaggaagcttatgttcagcaatactatcacctttggctggtaaattgatggaccgtcgcggcattcggcgaccattccaaattggtagtggctttttactgttggcaacactaagtctcgcagggttagcccagcatctctcggtcggcttgatcattggcttatttgttggctttcaaattgggttcagttgcttatttaacaatgccctgacgtatggtttacaacaattgccgccccaactaatgggcgatggcaacgcgcttttcaacaccctacaacagtattcaggttcgctcggtaccgccattatggccgtcttgattacattgggcacccgcatggcaccgagtgcttcgagtacgatgcaaaccaccctcggcacccagatcgcactctggttcagtctaattatcattatgattgtagctgctttagcgctgaccacgaaaccaattgcgaatatggctgacgaccaacatcaatcacggtcatctaaccactgatttgcttgggatttggttaagccgttaaaggcttcattaagcttcacgtcttctttacttctgaccactgagtttacggtaagatacagttaatccaaaccgaggagtggtgtgcatgcgttgggaaccgttcagaattattttaatagttgcaacactaagttgtttggtgatttttgtccacgttcgccagccacaagcccggacgcggcagctacttggcttaggttacttgtttggccttagcgtgattttgtttaccccgctgtcattcgacggaactgccatctacgtgatgccagctggtgtcggccaagtgaacctatcacggttgtatcttcacgggctgggctttatcgaaaatatcattctaacgattcccttaggctggggaattaaacgccactttcatcactacccactattgggcctcggattaacgggcttgttagtgggtgccagcattgaaagtctgcaatatttcatgtcacaacattggctgatcaatcgcagtagcgatatcaacgacgtcattgccaacgcaacgggtatcctgattggcggactcgtggcagctaccttccaatttgtggcccagcaccgcaagacaagcgtcacggattactgatcacaactgtatcctgaaacttgcacccccttgctggcagcttaatgctcaactgcgccgtaaatcacggcatggcgctcaacttaaattcacaaacccagtgacaaaaagacggttgttagaccaataatagtctaacaaccgtcttttgtggcgtcttctcaattttaatggttagttgtggacttgtcctcatgcgcggcacgttgcgcttgctgatcttgatgccagctagttggactccataattggccttccattgaaccccgtagactctcaatctcagcctgttggtcatcgatgaccttaatgatactctccacaacaacttgattatcagccgtcttcaaagcggcgagtgcctggatcgcccaggcagcctggtcttgttcactcattatgttaaaatctccgtttcctttaagcctttttacattgtacacaaaccaactgattataccaaggaatctgcttactcagcaaaggtaacgggcggtaatcggcaagtaaaataacgccctacaacgtgatacgctgttaagaagacacgcaacctaacgcgccatggtggctggctgatattgttctttcgacaaaaaaacgccccatcaagaatatcaacacaattcttgatgggccgctttcgtctcaaacgctaaatccgattaaccaactgcttgttgatcatcgtcataaagtttttgttgaatttcacgtaattcagacttacgtaccgaacgtggcaaaaatgcccgaatgtcctcttcgttataaccgatttgtaaccgccgaccatcataaatgattggccgcttgagtaattgtggtttttcaactaataggtccaataactgattgaagcctaagtccgacaaatcaatgtgtaatgctttgaaagccttagaacgcgttgaaacgatgtcctcgaagccattttcagtgagccggaggatttgtttcaattcatcgcgatccagaggattagcaataatgtcgcgttcattaaatggaatgttattctcaactaaccatgctcgtgcactacgactagacttgctggacgttgaataatataagtttactgtcacgatgaattcctcctaagtttcagcaagtgattttacaccacttactttaatatagtaagtatacggttttagtcaagaatagtcaaggtttgtcagaacttttttagttaattatttctaaagttctgccagccaattacccatcaaatgccagcgctattctgtacttgtgccgacaaaagcggtacctcacgagataccgctacttaactaaacatgaccaactgcccgggctgggatcgaaccagcgacctcttgattaacagtcaattattctaccgctgaactaccgggcaatgattatgtctgtatttatacacgcttttatgataaaaaacaagtcctttttaaaaaaagtcacactaaattcacataattaatatgatatccacctcaaacaacgtaccaacctaaccacgataccacggaaaagtcctgttttgaaaagcgttgtgccagtgtattagtgatttctaattcactcaatgtcgtttttaactcaaagtagtaatccccacgctgattatgcagtgccagttgccagctacctaaatcatcccagcaagtcgtatcgggagcggcctgttgatgcttaaacaacacgtgaaaagtcggcttccacgtctcgtgatcgtctcctgtgatacggatcaagcgacacacttcccggtgacaacgaatcgctgtccgaacaccaacgataatacctgccaccatcacccccgcaccaagtgccaacccaagtaataacaaccgggttaatagtggcgttgcttgcaattgcgagctaatcacaatcgtcgcactcatcatgagccagactaccaatacccagccattgagccagttcaaggcgacatcgcgagcatgtcgatacactgctaagcggtattgttgatcattattgaccactcgttgtttaggggccacagttgaataaaccaccgccatatcatcatgaaacgtataactagtaagtggttggaagaccgtcgtcatagcttgtaacgtcgtctgtggcatgtattcggcaatcagctgacgtgcttgtgggacttctttaaactgataactcagaccgtgaatcgccgtcaattgatagccccgcgccgcctgccgattgagccaagcaacctcggcagcagagcctttaagaaaaaagcgtcgtttttgcatactaggaatcctccatttcacaccgatttgagtccccattatatgccgattggtctacatttcaaatattcattaatcttagttcaacgccgttactaaccgttgtacaaaagtaatattatcaaaacaagcatggtaaccctttcctcatttcagcaaattggtatgggtacgatgattaattctcgatacttcatgggatgccagtttatatattaagttttttatatttattcacaagtccaactatccatgctagcatcaaagatgatgttattgattacaatcttcggaggaacaagttatgtcagccaaatatatcatggccattgacgaggggaccacgagtacccgcaccattatttttaatcacgccggtcaaaaagttgccgacgcccaaaaggagtttccacaatactttccgcaaccggggtgggtcgaacacgacgctactgaaatctggaacgcggtttcctcaacgatcgctaacgtcttaattgacgctaatattaaacctaatcaaatcgaagccatcgggatcaccaatcaacgtgagactaccgttgtctgggacaagcaaaccggtctacccatttataacgccattgtttggcagtcccggcaaactgcaccgttagctgagcaactcatcgctgatggtatgggcgatctgattcaccggcacaccggcctagtgaccgacgcctacttctcagcaacgaaaattcgctggatcttagaccacgttgatggtgcccaaaagcgcgcggaacgcggcgaacttcttttcgggactattgatacttggctcgtctggaaattgactggtggcgagacccacgtcaccgactacaccaacgccagtcgcaccatgttattcaacattcacgacttacaatgggaccaaacgattctgaacctactgaacattcctgctgcgatgctcccagaagtacggtccaactctgagatctatggcacgactaaggactacttgctttatggtagccaaattccaatcagcgggatggccggcgaccaacaagccgcactatttggtcagatggcctttgaacctggcatggtcaaaaatacttatggaaccggtgcctttaccgtcatgaatctgggcgagcaaccgcaattatccgaccacaaccttttaacgaccatcgcttacgggcttgatggcaacatcaattacgcgcttgaaggctccatcttcgtagcgggttcggccctgcaatggttacgcgatggcatgcaactgatcgaatcagcaccagaatccgaaagtcttgctcaacagtcccataatcacaacgaagtttacgtagttcccgcctttaccggattgggcgcaccttactgggattccgagacccgtggagccgtctttggcttaacccgcgggaccacccgggctgattttgttaaagccacgctacagtcactggcctaccagtcccgcgacgtcattgatacgatgaaaaacgacgccaacatcaccatgcccacactcatggtcgacggcggtgcagcccgcaacaactggctgatgcaatttcaagccgacatctcaaacgtcaagatcatccgggccgctgacctcgaaacgaccgcactcggtgctgcattcttagccggcctagccgtgggatactggcaagatttggacgaactcaaatcaatccaccaaaccggcaatgtcttccaaccccgaatggccgcgccccaacgtgcgaacctttaccaaggctggcaagccgccgtcaaagcagcccaactattcaagcacatcccaatcgacgcccaatcaagtaccaactaaactaaatttctaatcaaaaacgtcgcgactgaagtcagtcacgacgtttttagttcagcactattttccttgagtccatcactgccattctcatctatccgataatccgcactgtgtttgttgcttttcatgattaaaacgtgccaagtttttaagttcaaaagcaaccagcttagacccgctggaaaaagttcaggttagcgtaaacttgcttagttagtgtgtcctatgccgacttccaggcatttctgccaattgccggaacgtggtgggcacagatttaagccgaagcccacgtcttaaatactggcctttcaccactgggcattgtcagaaacgccttccagtcgggacagtgttcgaatggcagacggagatgtacccaacttttattggactcatcattgttcttcataaacagtaattttgtcgagcaactgtcaggcagaaaatgacattgtgatagcttactattttggaatcaccatagtagtaatcgaacgtttcaacaaagtggttagggtaaccctaacgtctcgtttaaagttcctgtatcaaaatagtcaatgaccaattgtgccgagttaagtggtcgttcatcagccattcgagcggcttcccgaaacgtgttcggtgccactaaagcctgtgcttgctacgccaacggactaatgccaaaaccgcattaatccgttggctaggcaatgctcggcttcaactcgtggccccgcacactcttgagactggaggggctgggtgacaatgctcagtagccaaattattcttagtcggaaatgatttccttccggcttagaataagactcgtatttgagatgacgcgggttgggcgttagctcaaatcgatgtcggcttacgttccagcaattgtcacccagccccggaggtcggaataggacgatcattgctgacgaacagaaatccacctaatcggcacgttttaatcatgattgatgacagattaatgaatatcgcgtggggtttatgataattgtagttcgtctacttttttgaaggcgtgactggctagaaatagcaggaatatgccggcataaaagagggcaaatagtaataagaatagccgtaaatcaaagcggtcagctaggaaagaaaacgctagcgaacccagcggtagggtcacggaaaccagcgtataaaagcaggtcattaccttcccgagttggtctgaaccgaccgtcgcttgaatcatcggtgtctcaaatacttgcgtcagtccttgaaagacaaagctcagtaagtaaatgatggcaaacagccagaactggttgtacgacactactgtcaagatcatgaataacgcacgcccaaagttgccgatgaggtaagactgccgaacggtcaacttttttaactgtcggtagactaccgtcatccctaataatattccaacggctgacatcgactccaaaataccgtagtagatcgagccaccgaaatgccgcccaaacaaaacgacgtacgtattcaaaccgccaaagaagaaattcatgacgacgctcgcaaacgtcaataaacgcagcagcggatcagtgctgataattttgaaaccaaccaaaatctggttgagatacaaggacttttcccgcgtgtgttgctgacggggttcagcgagtttgatccgcctaaaagtggcaacggtaacgacaaacgtggctgcatccatgattaaaacaccgagcactgagcagaggctgatcaaaaatccagacagcgcgttgaacacgtaatccgttcccttgtaggcaattgacatgtccgcttgtgcttgaactagctggtctggctcaacgagcagcggtactaatgtatcttgaatcggataagctagtgatccaaaaagggccgcgacgaataccagcccgacatagatacctggcaacttaatatgtaacgcaactaatccaattagcatgaccacgatcactaactgtgaaaattcaaccgcgactaataatcggcgtttagaatgtcggtcgatactgtcaccaaacagaaacaacaacacgcccggtaaaacaatagccacattcatgatgccgatccacaacgcactgttggtcaattggagaatgaaccagttcatggcaatcatgtagatgctgtcaccagcgttacccactgctcgccctaagacgagttttctgaagttggcattgatcacattatccgcccctttcaagccttgcaacaatgttactatcacacatcagaataaggatcgactcagctttcactcgaatctgcaacgcagcccgggcctgcttagtaaacatcgtctcagaattaattatattataattagtaaaaataacaatatttaatcttattttaatgttaagattcgtcctcccaggtaccaaaaaatctcccatgtcagctaatagcgacatgggagcgttacattaacggttatttttcgttcagccattctaattattagtgttatggtaacgattattggtctaattccggcaaaaagccctgctgcctagcgattgtcaaaaactctcgccgtttggccgctgagtgggtcgcttcctgcgtcatgtgcgctaagtgttccgtacgggcgtgactactccgatgttgataatactgattcaaaacgccatcaaaccggtccaactccgcctgataactcgcaggctcagcataggtatcttgaaacaacacagcgggcaaccctaatcgaggtttcttttcaggaacatccgctgggtgccctaactgcaacccaaagacgggtaacgtcaagtccggcaagtgtagtgcgtcaatcaccgcctgcgtgtcgttgttaattgatccaagtacaacgctaccaagacccatgctttcagcgaccatcaccatcgccgctgtaatcagcgtggcatcttcaatactaccagcaaagcggtcaaattcactcagtgcccgacgcgtcgttgcgcccggtgctagcttgacgttgcggtgttggtccgcaaccacaactaataaacggccgttttcaccaaccgttggcatcatcgtaatcgtggccaattgttgccgtagtgcaggctgagtgatctcaatcaaactgtatgcctgtaaatattggctagtcggcatttgttgtgccgttgtgatgatttgcgcgaattgcgcatcactaattggttcagtggtaaattgtcgccgcgttcgatggtcctgtaaggtttcaatcacactctttgtcacttaaaatcgctcctgttcttgttgtaattcccgtgaccagtccgttaattgtggcaacacgtccaggttcaagttaaacacaattcgttgacacacttgatcaagctgtacgctccgaaataagggataacgggtcctgccctgatcctggtgtatgataacacttaacgtaaccagctcatctaacgccgtttctaacagtgtcatcgcacgctgcggaaaatattctcgctgtagtgccggcgcgtccaatgagcagcctgccaacgcttcaacatctcgccgagtcaataacagactttccggatgttcgccaatcaatcgacttaaaatctgaacagtcaattgggtctcaaacgcgttacgaaaacgaaaacgggtctggaaatgactttgaataaattgtagcaatgccccattcttcatttaataacgagcctccttaaacatgcttattgataataacactgatactaacgtttgtaagttattttcccccattacgcacccgcaattaaatcaccacaatcagtcaatttcatgatccaaacaaaaaagctgagcttagagaattgacattctgaaagttcaacttttgagccagcgcctactaaaaaaacaaccgccgtttgataaacccacactcctgcgctagactttggctaacagcttttagccaatatgattttctttcaaaatcagatcgacctcagcttgcatgtcaggtgtttttgtccattcttcccaatgatccatcgtttcatcgggaatcgtaaatgtttcattaatatattgctcatacttggcaacatgcgtggaatgcggaatgtttagttgtaatatccgcacttgcttaataaaaccacgttcagctgctaactcagcgcggccattcatcaacatgtttccgatctccatgtatgaggtcccatcattacgtgttatttcttgaattaagtctaatacttcatggtttttcaactgcaatccctcacttcacattttagtataagcggggttggcagtcgtgtcaaaactgaccagtaattgccaggtgatcaggcttggtatgcctaatcacctgtacttgatgaacactaaactaactcagtcagccccaaaatgctaccatcagccgagcactcctttttctgagtaaacatcaatcttcaaaaattacaagagagccttatcttcatctggtccgccatcaattcgctaatttcactcaaaaaaccactatccaagcagatagtggtcggcataagagagaaagagaattgattagaaggtaattaaataccttacaaactaagaataagcgatattgtaagcgttgtcaacagttagtcaaaataaatagataaattatttctatttactcattaatctttttctaacaccctcagccagccatgttcgccactaaattgccgtctttacttgcacaaagttaattaattcaccttatttaatagattggtaccattcacaattaccaagatttaaaacaaacttctcaacctagataattttaattattatcaacaatcaattataattatttacactggttatttaaattgacttcactagcaactaaccctgtcactctcgcattaacacttgctgggttattattcgcattccctttaagaatgaaatatactaaaagtaggcggtaacatgtcaggcagctatgggagtgagggcattatgaaaataatcgagcatcaggaaaacgggattaattattatacattagtgaacaatcatcatatgagcgtcactattatggactggggcgccacagtcaccgcgatcaaaacccatgataaagatggtaattttgcaaatattgtcttgggatttgacgacggcgccgactacatcacctatcaatcttttttcggtgcaaccatcgctcgggttgcggggatcatcaaaaatgcccggtggcggcagtatgacttaactcaaaatgcgggcgaaaatcatctaaacggtggtaatatgcctcaaatttcatttgaaccatggtttttagaacgtaaactgcacactagtgatcaagttggactcgtcatgcaatatattaccttggacggtgagaacggctatcccgggacaatgacgatcacggctaatttcgtattagataacgacggtaaatttactattagctacactggtaaaagtgataaaacaaccttattcaaccccagcaaccatacctacttcaatctaagtggggatgcggaacgcctcattgaccaccatgttcttaaaatcaatgcagacgagtacgccgcgttaaacaaacacggtattccaactggtaagttgccatgggtcaccgacaccccatttgattttcgtgacccagtcgaggttgggccccaggttgctaacatcaagggcgggctccatcacggcttcgtcttaaacgacaccccatatccacaagtagaattactagatcgcatcagtggacgcaaagtcacgatgcgaacgaacgctccggcagtcgtggtttccagtgcaactaattaccgtgatgatcgttatcgactcaatggcggtaaaccgatgcgttctcaacttggtctttccctgcaagcacaaaaattaccggatgctattcaccacaaggaatttggcagtatcattatcgaacctaatattcctgtaacctaccaaacggcctatcgtttttctaatatttacgacgtctaaccactcaagaatgattcaaattgacctcccagaatgcaaactactgggagcttttttgactcactaataatgcgttacaccataccattgactgaacgaaaatctcctaacccattttagtcgacggacatggcctcattaccatttacctactaggcgcatatgctattatgcacgttgcgcgagttaatctgtcatgactcaggacgagttaactatcaaaataagtgctattatgataataatacccacatgtggcttaacgactagtacatttagcggcggtttaataatgaccaccccatcaaatgtaattaataaggaggatcagattatgccagctactgacttacgtgttcagcgcacccagactgcgctgaaagaggcttttcggacgcttgctttaaagtatccgcgctatcgtgatattactgttaaggagctcacaagtgtcgctaatatcaaccgcaaaactttctatttacatttcgattccattgacgatttagcggaaacgttcgttcaagaaggtgctgataagattctagcactcattgacccgcaagatttcaagaaaaacattagccaacccggcttaatctttgatcgcttagtgacctattttcgccaatctgaagcttttcaccgagtcattttgttgaatgatgattacagttttttgtctcggaaaatccacgctgccgtggtagcagggcttacaacgacgattcaaacaaactatcatttatctgcaatcgatgctaaggtctgttcaagctttttgatccacaacaatttaacctttttccggctctattttaatggtgatttaggactatctttggctgaactaaagcagcgcttagtttcgctcaacacttatggcattcatcaattcttctaccctaatcaatcactttaataggacccaaaaagctgagctatcgaataacgatgttcattcgatagctcagctttttactgactagttataggcttttaattatttaacaactcttgttcaatggttgctaataccccatcatgttcattatccagggtcgtcacgtgttttgctgcggcttgaatgtccgccggtgcgttgcacatcgcataactgtgcgctgcatatcgcaataatgggacatcattcgccccatcaccgaaggccatcacattagctgcagttaacccaagtttagtcgccaagaactgaattgctggtaattttccgacccgctgatcaaccaaatctacgacgccatacccactatcatgcgcacgtaactcgccatcaaaataatcattagctcgtgccaccagagcagcagcctggtccggtgacgttgagatactgatttttttaacggtatcatcaacagtggccagatccgcaaccaagtgtaaatgatcataaaactgacgggccatcgctactaacttatcaggtgctcctaactcagtatacgacccatggctaccaactaagattacgtatgcgtctttgaatagtggctggtgacgatcaacagtcacaaactttcgttgctggtctgctgaaagactaccatcaaagatcaagcggtcttgggcataaatcgacgccccattttcagcaacaacgataagattatccgccataacatctttaaataactgtctaagatgggcatattggttaccggacgaaagtactagggaaacgtttatcgcccgtaactgcgccaaaacccgtttaaaccgttctttgtcaaaacgctgatcttgatgcaataatgttccattcaagtcagttgcaattaaattgattgccacaagtagccaccccatcttttatcatttactaacaaaatcggcctcgtctcgtcatgtgattcagccgattaaacatcaacatgacactcagttacattgctacgaatactattgtagcataccactattgtcatgccataaatgtcgcgggtagttgcggtttggcaaaataatatccttgccctcgcgtaatgcctagatgattagccagttgaacatcagccgctgattcaatgccttcaaaggtaaatagcatttgctgttcctccgccttatcaaaccaaaatttgagcgtcgaaacaattgcatccgtagttggggtccccagcggtcgcatattttgtaacgcgaatttaaccgtattcacatatggcaacatcattttgatctgttggaataggttatcagaaccaacatcatcaaaagcaagtaatataccagctgcccggtacccaacacttaattgctgtaactcacttagctcaggtgtcgcaactagctcaacagttagttctcgtggtaacaaatgcgtctgcacatagtgactaattgcaacttgaaagtcaggattagcaaactgacgcgccgttaaattgatggaaacatgatggttatttaattcttgaatagcgcaatccagcaattgaatcaattctgttggcgctatttcaaaggtcgctggtattcgccaagtttgttgcctctcatcccactgtcgtaataataactcatacaagattgttcggttggttccaaggttattaattggctgtgcaaaatatttatatttcagcatgaccattcatccccaatagtctaattatttagttgtgttatcgcaaccgcttactttatcataccaaaagatcgtcaactttcacaatagtcttatgaatattagcagttaaaaattatgcaaaagctttgtgggcaatcaaaaaacgccaccgtaatcgaacggtgacgtttcttggtgcccacacacttactttaaattattcaacggtcacactcttggcaaggttccgtggtttgtccacatctaagcccttgtttaagctcgtgtagtaggccaataactgaccaggaacaacactaagcaaagccgttaatcgttcatcaaccgttggcaagataaccgtgtcaccatctttagctaaactatcggtgacgatagtaactgtcttagctccccgtgcagcaacttcttgtaagttggagcgggtcaacccagcggtattcttttgcgtaataatcccaatcactggggtatccttttcaatcaaagcaatcgtaccgtgctttaattcaccagatgcgaaaccttcagcttgaacgtaagagatttccttgagtttcaaggccgtttctaatgagacggcgtaatccagtccccgaccaatataaaaggcgtttggcgtattcaataaggcactcttagcaatcttttcaaaagtagccttttcatcaactaagctttgcatcccattagcgactaacgccaactgctgtttcacgtcgaaagctgttgcagctggttggtcaacggccacacctaacgctttagccaagatggcttgtaaggcaatctgtgcggtataggctttggttgaagcaaccgcaatttctgggccggcatgcaataacaacgtgtacgttgcttcgcgtgataacgttgagtttggcacgttcgtgatggtcaagcttgggaaatgttgatcgttcacattcaataacacttcacgactatcagcagtttcaccagactgggtcaagaagatgaagaatggatgtgctgataataatggttggttgtatgcaaattctgacgaaacgtgcacttcagttggcacgttagccaacgattcaaataactttgcaccaaccagaccagcatgataactagtcccagcagccacaatgtatagtcgatcggctgctttaagagctgttaacaagtcatcattgatgattggatcacccgcatcattaagataaacttgggatagcttccgcatcacattcggttgttcatcgatttcttttaacatgtagaatggataagttcccttgtcagcttgagctgcgtcaatgtcgacatggaatggcttccgttcaactggttcaccggcctggttcgtgattttaatttcatcaggtttaacgaccacgatttcgccatcatgtaattccaagaaatctttcgtttggtctaacatcgctaaactatctgagcagaccacgttaaagccttcgccgaccccaattaataatggactcttattctttgcgacgtataaggtgtcaggatcttccttatccatcagtaagaatccatatgaagaatggccgagcagacctaacgtcttacggaaagcggccaacgtactcaggccttccttggtgacaaaccgatcgactaattgaacaatgacttccgtatctgtttgagacttaaaagtcacgtcacttaaataagtctgttttaagtcttcaaagttttcgatcacaccattgtgaactaagtagaagcggccatccgcagaaacttgaggatgcgcattggcaacactcggttcaccgtgagtcgcccagcgagtatgcccaatcccggtcgaaccatgaacagcttcgcctacttctttacgtaagtcatcgatccgacccttttccttaactaaatagtcatgaccatcttgatcattgacatagataccagctgaatcatagcctcggtattccaacttttccaatccgttcaataagattgatactgcactatctttacccgttacaccaacaattccacacataaattaatcttcctttactgtttgaattgtttctagctgcgtagtcaatatatctgtcaccaacctcacagtcggtttttgtaattgacctgtagagtgcagtccctgacgtcacccgtcgattatcgataaacgtcatcctcgtcaactttagattctaaagtcctggcgctattccgctttaaccaattaacaattggtctagtctaacctccgattggtatatttcctagaaacaagttaactttaccgttacatctaacaaaagtcaacaatatattatattggtatacgtgttagttagcgtgtataccaatctcaaacgcttataaatcaagggcatcacgaattttcgaattttttgtaacttttttgcggtcaaattggtttgggaggcactgggtctcctgacagtcgccagttaaccgcgttgccaccgcgccaaccgcatttagcaatgaccgtgcgtttcatggcaacaaaaaagtcgcaactctaagagtaacgactttttttgatgatcggtctgatcacttaattattcaacgccaacttcagctttgaccacatcgacgatccgatctacataagcgctaaccagttcgtcggtcttcgcttctgccatgacccgcaataaatcttgggttccagaaggccgtaccaagacgcgaccatcaccggccatttcatcttcaacgtccttgataactgccttgatcttatcattgttcaaagcggctttcttgtcttgaaccttaacattcactaacttttgtgggtaagtcgtcacttcggcggctaattcagaaagcttcttacccgtttccttcatgacgtgcaataactgaattccagtcaacatgccatcacccgtcgtgttaaagtctaagaagaccacatgaccagattgttcaccaccaaggttatagccgtccttcaacatttcttcgacaacgtagcggtcaccaacttgggtctgcttgctgtgcaaaccagctgcttctaaggccttgtataagcccaggttactcatgaccgttgtgacgaccgtatcctgcttcaacttgcctcgttcactgaggaattttccacagatgtacataatcttgtcaccgtcaataatgtttccaagttcatcgactgcgatacaacggtcaccgtctccatcaaaggctaaaccaacttgagcgcctttttcaacgacgaatttagataatgcttcgggatgcgttgagccgacccctttgttgatgttcaagccatctggtgccgtagccatcgtatcaaattccacgttcaaatccgcaaaaatccgggaaactaagttactggtagaaccattggcaccatcgacagccaaatgaatgccacttaagtcatctggaatcgtttgttccaagaattgtgaatatttaagattaccctctggaaaatcagcaactgtccccagaccttctgctgctggccgtggtaaagtgtctttcggttgatccagtaattcttcgatttcttcttccttggcatcagacaacttgaagccgtcgccaccgaagaacttgatcccgttatcttcaactggattgtgagaagccgagatcatgacacccgcgtcagcatcttgaatccgtactaagtaggccactcctggcgtcgtaattacaccgagacgtaaaacttcaattccggctgaaagcaagccggcaatcaaggcttcttccagcatttggcccgaaatccgggtatcgcgtgcaactaaaacgcgtggttgcgtactcttgttttccgcatgttccgtcaatacgtagccaccagcacgacctaaacgaaaagccatttcaggtgttaagcctgaatttgcaattccccgaacaccatcagtaccaaaatatttcattataatttacctcatttcaaaagtgtcatgattaatcatttttaactgtaatttttactttgaccgacgttgggctaactgacgagatcccatcctcatcgctagtcgaaacatcgaccgtcttagtcgtggttgaatcaacattcgtcacatcaacattgactggcaaagacttcaacttcgccaatgccgccttcgtgccagtaaccgtcactgacttcgtgtcagatgagaatgaataactggtgtccgccgcggtcttgccactggctttcaaatcgattggcacatctttcgtcgttgtcgcctgcgtaatgggaatatacaccgacgtggtcgaaggcgtcaagacaacgttcaaattttgaccgttggcatctaatgcttcaatgatagcctgctggttcacggatttctctaaattcttgttggtattaacgaccgcaacgactttcgcgactttgctaacttcgctgacggcgcccgtaactttgacagatgatgttccgagccgtgccgatccaacttcataaccatctgctacgttggctttattgaaatctgcgctgaccttataagtagccgttcgtcgtggctgaatattaacatgaatgtacttttgactaagtccataactcaattctttattcaagccatcgacttcgactttgacactgtgccgcccaactgccaacttagataaattagcataaactttaaaattctgcgtgttagccgtagttgtgactaaagcagacggcccttcgatcgtaactttaatattttcgggatagcccgttacaaaatatttcgtactattcacgttcagttctaagggcgcgctaatggtcactttacggttagatgtcaatgtcgttttcgatgaactattcgtcaaaatactggcgttatgcgttgtctttaacgaattaacgtaggcgaagagcaccaacgcacacagcagtgctagtagccgcattgaccaattgctattcataaattttttcattttcggggacctcctccgaaaactcgtccaaaccaattttgaagcgcgttttgcttggttgaatcctcaggcgttagtaagacttggcggaaataccgtaagtaattttcacgcgtcatcccccgcatcagctcattgtccttagtaatcgacacttcaccggtttcttccgaaatgacgatggtgagggcatccgttacctcactgattccgaccgcggcacggtgccgagttcctaactctttaggaatcagattgctttcagataatggcaagtacgccgccgcaaccttgatttgattatcttgaataataacggcaccgtcatgtaacggcgtatttggaataaagatattaattaataattcgccggtgatatcagcatctaatgcgatcccagtctcgatataatcctcaagacccgtgtccatcttaatcgacattaaagcgccaattcgccgtttagccatatattggatggccttatccagttcggcaatcatccgctcttcatcttcattctgacgcttaccacgcgcaaacatggagccacgccctaaatgctccaatcctcgccgaatttcgggctggaatataataaccattgcaatgactgcccagttaataatttggtccataatccacgataccgtgtccagaccaatcaaaacactcacagctttaataatcgcaatgacaacgatcccgcgaaacagttgtacggctttagtgccccttagcaacacaatcagctcataaatgacaaaccataccgcaagaatgtcaaggagtcggacaaagttttgtaaggtcaacaaaccgctccaattgaaagtcattagtctcctcctcatgaaaatcatttactttcacattatagcacggcaacccggttctcgcggtgcgatttcagcagagcctgcgctttttagctagattttgaataaatattaagcttgatgttatttaatattgcttgattaatatttctgttagaattagtaccagaagggaagtgactaaatgactaagttacagcggtggtttgtgcgactcgcattctggggatttttcatcttcgcagcagtcgacttgcacggcgcgttccattttctattacttaattcaattttggcttatgtcccgatcgagctgagtttttggctgacaccccgacgtagcccgctattattttggctgattgcggtcatttggttgcttttctatccgaatgcaccgtacttaatgactgatttattccacctcagcctattgaagccgtatggcatcaacggtctcttgcgcttcgacttaccgatgtggcgggatttcgcttacttggttgggccaatgatggtgtctacaatcattggtacctggggcgttgaccgaattgcccagcaactgacccaacgtttacacttccagcgactccctgctagtcgtggtatcatctgtgccgcactcttcctatttgctagtgtcggtgtctacgttggccgattcctccgactgcactccatctacttactaattacgccacagtacattgtgaaacaattagttgaaatgtggtcgctaaagatgctcgcttttgtcttgatgatgtggttacttcaactcctcatctacgcggcttggcgattcacgatgccaacggttccttatcaaacaccggataagtcctagcgtaatcaaaaacaccgtttgaactgatttgataatcagttcaaacggtgtttcttattattaactaaatattagctaattcttcgtcttaggatcactatattcggtatgccgcccccgcttatcatgcaacccactgaagccactgaaacccagttcggtagccttttgttccgcatcgttgatataacgcaacgtatcgcttgcccgtttttcaccatagacttggacccattgatgaaaacgttcctcggaagccgtggtgatttcctgttccactttatgaccagcaggtgttaacgataagtacttgattcggcgatcatgcgtattcgtggtctgttcaatgtacttcaaatctaataacacgttgatttgacgtgcaatcgcactccgtgaaacccgctgctctttcgcaatcttgaccaacgtcagcggctcctcacttgttgcaatcatccgcataaccgtgtaggcctcaaacgttatcttatacggccgggtcggcactgaaacgaagtccccgacatattttaaaatatgcatataagtgtccacgaagcgttcatgaatttctgattctgtcataatgatgtttccccctgtaaggctgcccttattcgtccgcttaagtaatgattaatttgcaaacctaaccattcaccgtcaatactactctaacatcattataacctagaactactgatttacaatctaaaaagttaactaatcttcatcggcctcaatatcattgagcatcaataagttctccgagtaattaatgaactgccgtaactttgccgcggtgcgtaaactaatttgtccactctctaacaaatgctgtacacccgcacgttcggcaccaagactcttgatgcgtagtccatgcagctgttgttcataatcatcacgtgataacgtgtgatcatttttcgcattctcgatgcgattccggtaatgaacgatcaagtgatacagagcctggcgatcaaactgttgctcatcaacgttggcctgtttgagatactgcgacaacgctttaatagcagctttagaagcttcacgctgaatatccaacaacgccactcgtaattcttcgctatcgccaggtgctaaccatagtcgaatcccttgcattgcgcgcgtcaacaacaaccgtaatgagcgcagtgtcggaagcccctgtcgatgtgtcgcctgtaagaaacgttgttcgcgccgatcgacacgccgcaagtagacctgtccagctaacttactagtttgtttattggcaatcatttctctaactgctgcccgttcaccattcagtgccactaagcgaagttccaattcatctgtcagcatcggcgccaactcatccgcagtctgcgacgccacttctagacgccgaatctgaaactgctggtccaggatcaaatcataggccgcacgttggttagctggccgccgatgttcttcaatattttgaatcgctaactgtaagatataaatgcgggcttgcttgtatgttaactgtggtaattgcccactgctatcatcaccgtcatccgttccgtctgccaagaccgcgtcgtcttcatccggactggatccccgagtaacaaaggggagagatttggccgccatcaatggcaaaatagccgcagcagcaactaaacttacaatgatgactccagccgcaatgaacagtacgagcgcacgttccggaaaggctttgcccgaggccaccacggttggaatcgtgaagaccccagccatcgtaatggccccccgcacacctgataaaccggacaatgctgcaattctgagactaggtttggccttcttgtgatgtcgtaaccagttgaacaacatgtaagtgtatgtccaagcaacccgaatcagtaacaaaatcccccagacgattaaaacgtcaaagaccgcatgaaacgtatttgtatgcgcgcctttaatggttgcttgcgttgctgccggcaattcaataccaagaatcaggaagacgatcccattcaataagtaaacaaccacgttccagacccgttccgtcactaatcgtaattccggcgcatcttcactttcatgtgaattttgcaagtgcgataataccccggccgcaacaacggcgacaacaccggacgcgtggaaccattcttcagcaatgaaataaattgcaaacggcgtgagaatctgtaacaccacgttgaacacgatatcgttgataccctctcgtcgtaacacgtcccgaatgagttgaatgatcgtgatcagcgccagcccaacggccaaaccgaccagactaatatagaagaaatccccaacagcttcaccgagtacaaacgtaccggtaaccgctgctgctaacgcatatttgaacccaattaacccactcgcatcattaatcaggctttcgccactgaccaagtgcaaaatttctttaggtaacttgaccccttccgagatcgactgcacggcaatcggatcagttggcgataaaatggccgccaacgcgattccaacagcgagcggaatcgttgggatcaatacgtgaatcaaaaagccaccgagaatggtggtaataaagacgaggacgattgcattcgcaaaaattgccccgcgtagttcccataattcctgttttggaaattctctgccatcgttgtacagcatgggcgcaataaagacgagcataaaccaatccgtttgcaattttacctgtacatttaataataaagccactcctagacccagcccgacttgaattaaactgaccgggattgcgactagatagtggctcaatacattcgacagcagcactaaacatgccagtaaaatcactaattcgataatcggcatctagtggttgccccctttgttaaattgacataactaaccttgaacgacgtcttcaccaatgattcggacttccgtctgaagatggacgccaaaccgctcaaatacaactgtctggacgtagtgaatcatatccatataatcggtcgctgtagcgtgatcgacattgataataaaacccgcgtgtttcttagaaacttcagcaccaccgattcgatggccttgtaagccagcatcatgaatcagtttaccagtaaaatacccagttggtcgcttaaaaacactcccgcatgatggccattccaacggttgtttggctgctcgcaacgtattcaattcgtccatccgcgcttgaatcttggtctgattacctggcttgagaccaaacgtcaccgatacgacaatatcatcatagtcctggatcgtactgtgccgatagccaaaatctaattcgtcatgatccagggttttaagctgacccgctggcgtcaaaaccgtcaccgtttcaacaacttcactcatttcgccgccgtacgcaccagcattcatgaaaatcgcacccccgacactaccgggaatcccagctgcgaattcgagaccagtcaagctagcgccacaagcaaccttagtcgtcgcaataattgcggcaccagcttcagcaacaactttggtgccactcgcatgaatttgcttcatgcgggtgagaatgatcgttaatccacggataccaccatctttgacaatcaaattactggcattaccaatcacggttagtggtaaattttgctcattggcaaacgtaatcagagctttcgtctcgctgattgactttggaaacgcaacgtaatcggcgggaccgcctgttttagtattcgtataatgacttagtgattcattttttttaatttcgatggctggaaaagtggccaagacatctttggtcatggtgaaaagttcctttcgtgtttcgatttaattcacttacgttaataatcactttaaccgcatagcgtttttaatttaggccgacgtatcaagcaccgcagcattgaaacgctattgaaacgatataatcaggttgaaatttgtaagcctatcagttaattttagcactttttaatcacttaataaatgacggcacaccgcgtgactggtaattgcgccagttggggcgactggattaggcccgtgcgttgttaccgccgtcagaaaagcacggatcagcggtgcaaatcctcgcttttccaatgtcggtgtccaatccggaaaagccgtcgtggtagttgttgccgtcgtcatcacggttttagtacttaaatcagtcacagacgcacgttgccccgtcgtttggactgtcacttgttccagattgaccccaccgtacatattcgtgataacttctaattgctcatgagccgtctgcaccgtcaaatagccttgcgccaacgcgccagttgccgccgtcgtcaaccgaccactagtgtgttcaagtggttcatctaacaagaatagccccgtatcgaccatgtggatcatcaggtcgaaaaccgccgtttcaggatcttgactacccacttcgcgaaccttttcagccactaacatccgtttgtcaggcaatgccttcaattgctgattaaaaggagcaaaacgccgattaaacccacaagtcaataacaggtgccgcgccgcagccaaatcatacaaactttggaccacctgaagatcagtcgcgactggcttatcgacataaacgtgaatcccagctaataacaactgcttgatgattgctgcatgcgtgtccgtgggagtatgcacaaatacggccgccggtttaactgccattaattcctcaagggtcgcatgggtgtgttgaaacccatacatcgtcgctagttgtgctcgtttttccggattacgcgtcgttagatgaaattcatactggtcttgcatcgccgccatgacgggtaaatacgccttttgagcaatgttacctaaaccaatgaccccaatttttaacatcgatattcctccaattttatcatcaatcttcttttagctactactgattgctccgtggcacactgatttaaatcattcagcgtccaattcatgccagtgattgttagctggaaaaacgtgccatcactgaaagtcaaagatacccgctcggacgcgctgaaactaggccaaccaaagacaccagcatgctttgtcaccctatcgcacatctatccgccgtgtctggctttaatcacggcgcactgattcaattgtcattaaaataaccagtggctaccgtgttacaatatgagtaaattacttgaaaggtctgaaactcacgtgaaacttatctcttggaacgttaatggactgcgtgctgccgtcaaacacggctttgtcacgacttttaatgagctcgatgccgactttttctgtgtacaagaaacgaaattgcaggcgggccaaattgaactggacttcccaggttattatcaatactggaactatgccgagcgcaagggttattcgggtacggcgatttttaccaaacacgagccgctcaatgtaacttatggtatcggtgtaccagaattcgatgacgaaggtcgcgtcatcacccttgaatatgcggactactacgtcttgacgtgttacacccctaattcaggcggtgaattaaaacgtctcgactatcggcaacagtgggaagatgcttttctcacatatattaacagtttgagtgccaacaagccgttgatcttttgtggtgatcttaacgtggcccacgaaaacatcgacttgaagaactggcgtagcaatcaccatagtgccggcttcactgacgaagaacggaccaagtttgaccgcctccttgcagcgggctataccgacacattccggcatttctatcctgaccaaaccgacatttactcatggtggagttatcgtgggcatgcacgtgacaacaattctggttggcgaattgactactttattacgtcacagcaattagacagtcagctcctaaacgcccgcattcataatgaaatttttggttccgatcactgtccagtggaactcgatattatccttccgaaccattaacttgaaaattaacgagattctttgtacgataatcctattctttagaaacggtggtggcaactttgaactttgtcgcaatggactttgaaacggcgaacgcgaaacgcgacagtgcttgttcactggcgctaacggttgtccgtaataaccaaatcagcgatgaattttacacactcatcaaaccagagagcgattttttctggcggaacgtccaaattcatgggattcatgaagcagatgtcgcagacgcgcccaagtttccagacgtttggcaacacattgaaccatttttccaacgcgaccacctcgtaattgcgcacaacgcgccttttgatattggtgtgttacgcaatacgcttgcccactacggcatcagcgcgccggagtacctatccatggacaccgtcaagaccagtcaacggttctatccagaattgcctaatcacaagctggatacagtctgtcaagcactggatatcgacctgcagcatcatcataatgcactagatgacagcctagcttgcgccaacattttactcaccgaagcgcaagcttttggaactgagcaactcaaacctttcgttcgcgttcagggttaaaattaaatttatgcaagttcagcaataagatgctggacttttttgtttacgcatcactaccgattatcaatactcgtagacagcttatcaattcccccaaccgactgggagatgagccaatcattcacaagcagtcgccggttaggcctggttcgtcaacgcttaaattccggcccatctactatcagaacctgtttaccgtcagttcagcgaatcccggatttcaaacccagattcccatatcaatagctggaacccgtttgccggttgggtcaacgacatcatagctcgttgccgtacaattttcgaacccaagatgctggtacagcttaacggcacgcacatttcgtaactggaccgtcaacacgaggcgttccaatgagctatagttacgcgcccaatctaagacttcctcaatcaaagcagtccccagacccatgccccaaaattctttaagtaccgctacgccaacttcaccttgcgccgcactaaaatccgtactagcttgcacggtgctcacaccaatcaaccgtgaatctaatgtcgcaacgaaaataatgttggtcgttgtgccattgatacgctcaatttgcgcctgttcatccgtttcgctcaaatcctcaatgccctcatcaacagtgaaagtattactttcacgtccgagctgagcgagtagcgctaataattgtgctgcatccgcgacttcagcaggccgtacatcaacaacttcttctgccatggttgtcactccttcaattgatcaaccagtcgttgatagtgttcaccaatgggcttgaaggttattacccgctggtcatcggcatcagtgtcccggctaattgcaattcgcaagtaagtcgtcggtaagaggtcggcaataaactgtgaccattccacaacactaacgccatcaccatcaaagtattcatctaagcctaaatcttccgcaccgccatcttccaagcggtaaacatccatatgatagagcggtagtcgcccctgacgatattcccggatgagcgtaaaagtcggactcttaacgttattaggaatgcccaggctttttgctaacccctttgtaaaagttgtcttaccagcacctaaatcaccatctagtaagattaaatcaccaggttgcactaattggccaagtttggccccgattgccatggttgcttccggcgacgttaccgtgattgattccatattcttccaactcctcatccaaattaactgttcttattatagaaaaaacgaaggaaacttcaaagtacaagctctgaagtttccctcgtttaacaaactaagtgaccgtttaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatgtgataaccctccaataaattaattaatgctcaagattgacgtgctctggtaactgccaattgattggctgttcgccgaaggatgttaacgcaatgttcgtttttgaaaatggtttggacccaaagaatccgcgataagctgaaagcggactcggatgaggtgcttgtagcacgacattcgtctgggtatcaatcagcttaatcttggaccgagccgccttaccccacaagataaagacaaccggcgtcgatcgttccgataaacgctgaatggcaacgtccgtaagtcgttcccagcccttaccagcgtgtgaaaaggccacaccattttgaacagtcagcacagagttcaataacaagactccctgcttggcccaactttccaagtaaccgtggttgacgggcgtacacccaacatcatcttgcaattctttatagatattgactagtgatgggggcactgccacgcccggtaacactgaaaaactcagtccgtgtgcctgaccaggaccatgatacggatcctgacctaaaataacgaccttcgtgtcagcaaatggcgtccattcaaaggcctgaaaaatattatacatatctgggtgaatatttttcgttcggtattcatttttcaaaaattcgtgtaattggtggtaatacggcttctcaaactctggttttaagacgtcccaccagtccgtgtgaataaacgctttcatccttaacacctctcgttttattgtatcataaccaaaaccactaatgataataattctgtattcagacgtaaacatgttagaatgtaattattaaaacaactaaggatgtgacaacatgatttcgattatcgcctctgatatggacggaacgttactcaacaatgaaatggtcgtttccgattttaacgctaatgccatccgtcaagcacaacagcaaggcgtgcactttatcgtctccaccggccgccgattttctgaagctcagccactactggccgctcaaggcatcacggcacccttgattacgttaaacggtgccgaagtatacgacgcttctggcaaaatgctcgacatggtgcccataaccaatagcgtggcccgcaccgtttttcacacgctaacctcacaaggttactattttgaagtcgtaggcaacgatggtatttactctaacagtaaagccaagcgaatcgaacaaattgcacatctcctaactaacctgaatccagatacaacgttcaaaattgcggtatcgctcgcgtcagcccgcttagaacttatggacatcaattacgtggacaactataacgagttattggatgatccgactaagcatgtcatgaagattatcgctttcagcgaagaagggcccgctaagctaaaaccccttagtgatgaaattctggcaaaacattcgtccctcaaaatcacatcttcatccgcatcaaatatcgaaatcaataatattaatgcgcaaaaagggattgcagtcgagcgctatgcgaatatgctgaataccccaatgagcgatgtcatggcgattggtgataataataatgacgtctccatgctcgaattagctggcgtaagttacgctatgggtaatgccagtcccgaagtcaaacagttggcccgctatatcactgatacaaatgtcaacgatggtgtcggcaaagcaatcttagaagtgcttgccaaacaatagtttccggaaaacggaggttgaagatgcgtaaattatatttcagccgcaatagcttcgcccaaggtgcccggattgttcgcgatgcgcacaaccaatctcactatctcttagttggtcggtgggggcggcgccaagacgcgctcagtttatacgcgatccaaggtgagctacttgccgaaattcgacaaacaaccctcggattgttgccaaaattcgatttatactataaccgtcaaaacgtcggttctattagtaaaacgctgggcttctggcatgaaatgctctatgttcgcaagcttcgctggattatcatgggaagcttgagtgccgaaaactaccgcgtttatcatggtactgaattaatcatgacgatgcgaccagttgtcaccactaacggtgaagcatttgaattagcaattactgatcaatccacagaaccactgtgtatttgcattgcggcgatcctggatcactggcaaaagccgaccaaccgcgcgcggacaccaattgcgaaaaagggactcaatgttagctttggtgaaagtaattatacattgacaccccgtaataaggtgccccaacactaaatagaactagccataaaacaacggccacccctgtttcgggatgaccgttgtttttagttaagttggcataactagtttgccagcttaacaccctatcaaagttgacgtgccgatcaagttgcccatatcacggtattcactagttaatcgtcctcagagcaacaccgcttcatctgctatgcaagcacgttactacagaataggcgcgccaagaattaaaccaattcttagcgcgcctatttgacgggttattttattatgaccagccgatacttaaacgttgatcactttttgtaagaaatcttgtaaccggggactttgtgggtgttcgaatacatcctcaggcttccccgtttcttgaatcaacccatccgccataaagacgacccggtcggccacttccttggcaaagcccatttcgtgcgtgaccacaatcatcgtcataccatctgcggctaatttcttcataacatccaacacatccccgaccatttcgggatccagtgctgaagttggttcatcaaacaacatgattttcggatgcatggctagcgctcgagcgatggccacccgctgcttttgcccaccagacaaggacttaggcatggcatccgccttatcggacaagccgaccgtggcaagtaagtcacgcgctgttttctcagcttcctgttgactttcctttttgagttgagtcggtgctaaggtaatattttgtaacactgataggtgtggaaataagttaaagtgttggaacaccatcccaatattttcacggaccaaattaatgttagtccccttgtcagaaagatcataaccgctaatgacaacttgcccttgtgttggaacttccaagtcatttaagcagcgtaaaaacgtacttttaccagaaccagatggtccaatcatgcagactacttcgttatcttgaacttcaaggtttaaccctttcaagacttcgttatcgccgtagcttttatgcaaatctttgacaattactttcgccatgcttagttaatcctcctttgaacccagttagataaccatgttaataacgtaatgataatcagataaataatcgcaatcattaaccaaatcttaaagccttcgaagttccgggcaataatcaacgtcccagtttgggttaattcaacgatcccaataacggatagaattgacgtatccttcagcgtgataataaattggttaatgaacgacggaatcatgattcgaattccttggggcataataaccttgcgcatggccgtccagtatggcaacccgagtgaacgggctgcctccatttgaccatcgtcgactgcggcaaagccccccttaacaaaggctccggtataggccccttcgttaagcatcaacgtaatcatcccagcaacgaacgcgggaatcttaaagccgtgcccaatcaggtctgggaatccaatgtaaataaagaaggccaacaccatcaatggcatcccacggaaaatataaataatcgtactggagatggccggaccaagtttacccggcataacgcctaagaccccaagaatcagtccgaggatcgtcgctaaaataattgaaataaccgttaattccaaggtcatccataaccctgagccaatcgtatccaagttttgggtgaacaagccaataaaggtccgactgcttgcgtcttcacccgttaaggatgcttcactagacttcaagtacttgttaatgatctttttgtaagtaccatccgctttaatcgctttgagacccgcgttaaatttctttaacagttccgcgtttttaccttttttaaccgcgaaaccatagtcgccggcctcgtgttgcttggaaacaatcttcaacgcgatgccattcttgattccgtatgacatcacgggatagtcttcaaaacaagcagccgagttgccgaccttaacatcgttatacatgttattcgagtcattgaaatacttgattttgaagccgtacttgctctgaatcgacttcgcataggttgcaccagctgtccccgttttaagggccacggtcttacctttcaaatctttaaacgttttgaccttgctatctttagccacagccataaccaccccggaagtatagtaagcgtctgaaaaatcaaacgtctgcttccgttcagccgtaatattcattccggcaattaccccatcaacttggttcgcactaagctgctgaacagcggcaccgaaactaagcgcttttaatttataattgaaattttcttttttggcaattgccttcaaaatatcgatatcaattcccttatacttaccacccttgacctgaaattcgaacggcgcaaaggttgtatccgtcgcaatcgtatacgtcttagcctgggcctgggtaccaatcgcaaaccagcttcccaacgctgctaacaacatgacaactgcaacttgccactttctcatcgacgagacctcctcaaatagtttaccggaacggtatgtcataaaatataacataattcatttctcgtgaccaattcaattttttatacttttttaatttagctttaatgatgtcgctatcatcagctgtttacttaataaaataaagtaaatagtcatttctagcaaagattctgatgaaagtaccccctttttatgttttaaaattttgttcaagcattaatcactgcttaactgaatacttgacactagattcatcaacccgcgcaaccagccgttaagtccaaacagcagcagttaacaaaacggaccaattcaaaatgaatcggtccgttgcaagaaatcgctatcaattttagctaatcgatgaacttaacacgccaatcgtacgcttaatcctcatgcgtatgccgccgacgtcctaatcccattaaccctaataatcccgttaatccgagtactaccgcgccttgttgtgctgagcggtcgcgctcgcccgtctgtggcagtgtgtcagcagtcgtgtcagttactcgtgtcacaggtgtcgctgctgctttggctgcgctagtatgctcattgttggccggtagagctggctcagcggtcgtcttgaccttagtctgtgcacgagtagccgtggccggttgttgctttgtcgtaatccgatcatcaacgccccagtcgacggtatgaccatccgaatcgttaggtcgctcactcggcttcggtgtttcactaggatcagcgatacctgcatgatcattgccgtcagggttagatgtttcgccgtgatcattgttgtcaggtacggtcgttccaccatgatcattgttatcagggtcggtcgtgttaatgtgatcatcgtcaggtaagacgacggtcaccacggccgttttagttaactgattaccggcaacatcagtatagtggtaagtcaacgtgtactggccagcgcgttgtgtgttgaccgtaccatcgaccgcgatatcagctaatgtcagcacttggccctgggcatcggttgcacgttcgaaattatcctgagcagcccaagtgtttccgacggtcaacttactatcacgcacttgtaactgggcctgactagccaatacatcgatactcgtcgtgacagtaatcagattacccgcacggtccatgtaacttagtgtcagtgggtaattgccggcccgccgtaagttcagggtaccatctacagtcacccgctggcgctgcgctgctgtcagcaacgtgccatccgctgccaaactcgttgaccagtcaacactatcattcagtgaccaggtcgtcttagggccggcaatcacggtaactggccgcgtactgattttagcctgcgtggcaacggttgtcacttggaccaacgccgtttgttgttgtcccagcgagtccgtgtaaaccagttgcacagtttgtggctgcccaatatgggcaaccgttaagtctggcatcgccacgactgtaatagcggcattattgaccgcaatcggctggcccataccatcagtaatcgttccaataccctgatgataatcccacttggcagtcggacccgcgatgaccgtttgtggctgagtcgttaatgctgcttggtcgactgtcaccgtcgtagtcgcagtttttacgttgcccacctcatcagtatatgtcagggtgacttgttgtttcccagcctgttgagcattgatggtcgtcatcgtaacactttgataattttgactagtctggccccaggcgtccgttaaaccagtgactagatccgcaaccgttaattttccgacaactgcaggccagatcacctgatcagcactagtcgtcatgtgcgcccgtgaggcgactgttgtgacctccgccgtggtggtttgggtcaatcctaattcatcagtgtaactgaacgtaacgacttgaggccgccccaccatggctgtactcaagtccgggcctgtcaagactttaagattggcatcaccgacattaatcacttcaccggcagcattcgtcacggttttaaagttcgtctgataatcccaatgggcagtcggcccggcaaccggtcgagcggtttgggtcgttaaggcggcttgatcaaccgtcacttgggcagttgttgtcacctcgttgccgtaatcatcggtatacgttagagtcaccgtttgggcaccaggctggctggcatcgaccgcactcatcttgacattggtcaaagacgacacttgagtgccatccgcgccggtaatcgtttgcaaaaagttggctggcgtcagtagccccgcatctttggcccatacaatctgtgccggacgtggcacgagtgccgcctgtgatgccgttaaggtcaaagtagctgacacagtatgtgtctgttgtagatcatccgtgtacatcaaggtaaccgtttgcggcttatcgatcattttagccgttagttgcgggccggttatgaccgtaatcttagcttgatcaggattaaactggtggccttgcgaatccgtaacagtcgccaattgttgccgataatcccaagtcatacttggcccccagatttgagtccggttctgactatcaatcttggcctgatcaaccgttacttttacaacggtacttacttcgttaccagccgcatccgtataagttaatgagacgggttgaacacctggccaggtcgcgtctagcttagacatccgaacgatttgataatcagtcacctgttgtccagaggcgtccgttaagctcgttacaaggtcattagccgttagcttcgccgcggcatccggttgcacgataactgccgccttggccgttaacgtagcttgtgaggcctcagctgtcaccattgccgtgaccgactgggatttcccgagctcatccgtataaatcagtgtgatcagctgttgttgcccgactgaatcaacattcagatctggcctgttcaacactttaattgtccccggttggacggtaataagttgcccagctgcattcgtcaactgactaataccggcttcgtaactccacgttgccgtcgggccggcaattaccgtacttggttttgtcactagctttgcctggtcgactgtcacattggcatacgcgacggattgattacccgcaacatccgtgtaagtcaacgtcaaacgttgctgccccgctaacttggaatccagcacactcattttgacattgtcgtgatttgtaatcagatgaccttcagcatcgtataaacgatcaactaagtccgttgccgtcagttgtttagcttgatcaggccaaataatctggtcagcaacagccgtgatcttcgcctttgaaagcgtcgtcgttacaatcacgtcggtcgtgtgaactttacccagactgtcagtataggtcaacgtaaccgtctgaggcttgcccacctttgccggagttaaatccggcgtcgtggctgtaatgtcagcatcgccgacatcaattatctttccgttggcatcgataacttgagtgacgctgtcacggtaatcccaagtcgcggttggaccggcaattgggtgtgtcgcttgaccagtgattgtggcgaaatccacggtgactgtcgtcgaatcagtcgtttggttaccatacgcatccgaatacgtcagtgtcacggtttgtggcccgatagctttagcatcaaaaccactcatcgtcacatcgtcaaaattcgtggctttatttcccgccgcatcaattaactcactgaccaggtcggttgccgtcagctttttggcttcatcaggtatgatgatctggtcgctgacagccgtaatcttcgccttcgaagccaccgtgttgacaaccgcagtgactaagtgttctttgcccaactcatccgtataactgagtgtcaccgtttggtcatggccgaccatcgcaacacttaaatcaggttcagtaacgactttaatatcagcggttgcgagattatcaagcaactttccatttgcatccttgacccattccaaaccagctagatagtcccatttagctttaggccccgcaattggattcgttagcttggtcttcaaatctgattggtcaaccgttactttggcataagctgtcactagattgccagcttcatccgtataagtaatagtaacggtctgcgcgccacccttgctcgtgtcaattgaactcattgtgacatctgttaggttggtactagtatcgacggggttcccgttggcagccgtgattgtcaccaaatcggcgacttttaattgagcaacctcactgggccaaatcgttaacggcgccttggttgtaacttgtgcctgagaagcaacgactgttacttgagttgggacgctgatgacattgcccaacgcatccgtatacgtgagtgtgacagtttgcgacccaatttgcgttaaatcaggttgctgatcaaccacaatgttaagtccatctaaactaaccgggttcccatcaaaatcagtgacactcgtgacatactggcggtagtcccaacttgagtttttgggtcctttaatgatagtactattacgcattgttaagtcggccttagttgcgaccatcgtcaccgtggtggttgtcgtgtggaccatgccagtagcatcatccgtatacgccagcgtaaccgtttgtgcgccagctttactcgtatccaagcctgtaaccgtagccgtcgcgagttcgtcagcacttagcttatcgccggccgcattgcgggagttgtccgtgtcgattaaatcattaatcgtatacgttggcttagcacccattttgatcgccaacggtttaccaactagtttgccttgatttaccgctaccgcaaccgtactagtttgctgccatactttgccatacgcatccgtatactgcaagtcaacttgataggtaccggcagtttgagtgtcgaccgtcgttacagcagtatcgccgttcacgctaatcactttgacgactgtgtcagcggtcgcataaatatcggtcccattcacatcttttagtgttgcaacactatcggcaactcgccacgtcgtcttcggcccggcaattaatccggttacattcttggacgtgaaatcagcataggatgggctagtttcccagacccaagtgattgtatcggctggattatcgacgccattatacaaagccattaactcactcgacgtatacgtctgggtggcatcagcttgattgacccatttaccggtatagccagttccagttggaatgtctggcaatgaactaccgactaaatatgtttttgacccaaccgttaatgcgtttaggttcatgggcaacggattcccgctactatcttgattcaaaaacatatcatgatctgcaggttccttattcatatcagcttcagtgactgctgcaaagttagacatgtccaaactcgcaatgttgattgcctttaatccaggggttccctcaaacataaacttagtactagttaacgtactgcccgtctgccagcccgttatatcaagatcagtgagattggtatcatttaaaaacatcgatgacaacgctgtaacattcaacaagttccagccatgtaaatccgccgttgttaaactcttatctccattgaataacccatctatatccgtgaccatccgcacattccaagtacttagaacaatactggtcaaggccgtgttaaatgaaaacattctttttaagctcactggttgaaccgtattcaactgccactgacttaaatcataagattgaactcgcgagtcactggcgaacatagagtcaaaggacgtaccagaactgacattccaatgcgctaatcctgaaaagtcagcaatcttagttcccataaacatcattgaaaagtcagtgactttcgaagtatccagattttcaaggccatcaatactggccaaatttggattataccggaacatataactagtatcagtccccgcattaattggaccatcaatcactactttcgttaactcactgccaaaatcccccggtacgtcgctgacatcacccactccggtccaatcaccagcatgaatcgtcaacacaccatcatctgtgtactgccaggcacttgttcccagagtcccagttgagacaacaattgcgggtatggcggctcgcgctaatagtgcccgatttaactggactttatcgttagtcgtcgtaattgtattagttgtggcagttacaactatcggactagtttctgaatccacaactttttcagtttcattagaatctttcgagtctgagtcaccaatgctggccattgtgctagtacttggcgatgcgacacttgaacgattagtttgtagtgattcatcagccaccaccgtgtccgtcacattagattgaatgccactctcagagcccgttccttgatcattttgataatcagaattttgtgttgtgactttctgtgaactcgatgcgacacttactgagctgtttgacgtttggtccaaactgtcgccagaaccagttttagcctgactgcttgctgatgccgaatcagaggtactgagattactggttgcgttttcattttctcctactgccgtaaccggttgttcagcctttgagtcagtagtggtgccactaaccgcctgttttttttgagcactagtatttgttgttgccgcattaatcgccgtcgcactagactgagtcgttgcccctgttgtactagtcgtagtagtccttaaaacctgtgagttggatgatgaggatgccccagcagtggtcgtagctgcggtggctgcggtcgtcgtttccgtatctgcccgacttatcagtggattcagagtaaaggtagccacggtaataccagcaaatacccagaaacgtccctttttatacattttataatgctgcttgctcgttataaatctattcatacatgtccccccaagaatccatgcaataaatcatatcaaaattaacttattatcaatttgagttatactaaatctgattaatatcagaataataacattctccaaagtttagtatcaattatatttattgaatcaattaataaataacgcgtttaactatcaatacaattatatgctaacataattaccagctaagtcgcaagtgcttgtacccgacctttcgcaaaatatttatagcctgataaccattttgctagtatctagaacatttataacagtgagcactacatcagtacatataaaatatatgcttgccgtcgtccgtccacggcacagaaccaccaacaacacatactaaaaaaggtcttccaagaatcgaattaattcttggaagacctttttatgacgctgccatactcgttgtatggtgcagcgatgcaacgctaacgtaatcgatgcctagtaatgtttcataacccggtcgatttgacgctgttgttcgcgtttcttgatatcttgccgtttgtcgtattcccgtttcccgtgagcgactccaattaagactttcgcaaatccatgcttgagatacatcttaagtggaataatcgtcacacccttagtcatcgttgctgcacctagcttactgatttctttcttgtgcaacaaaagtttccgggaccgcaacgggtcaacgttataacggttaccctctttaaacggactaatgtgaacgttttgcatccaggcttcaccgttgcgaacttgaacgaaaccatcctttaagttgacccgccgatcgcgaacggatttgatttccgtccccgtcagcgcaatgccagcttcataggtttcctcaacagcgtagtcatggcgtgctttccgattttgagcgagggcggtatctgggtgcttaccgtgttgtttggccattgccgcacatccccttacttaaaaattaacgccgacgatcagttgatgaccgccgattgttgttagtactatgattattattgttgctattatgattattattgttccggcgaccattgctattgccattacgatggttattgttgttgccaccacgatggtcgttattccggttattattgttcccatttcgccggtagttaccgttattgccaccacgccggttattaccacgatagttatcatgatgttcccgctttggcaataaatcagtctttggcgcttcttcaggattcaataacttaaagtcgacttctcgttgatccttatcgacccgcattagttgaactttgacgggctggccgattctaaatgtccgtttcgtcttacggccaaccaacgctaattgtttttcaacgtattcgtagtagtcgtcgtccatcgtactgatatgaactaagccttcaacggtattttctagttcaacaaacagaccgaatttcataacggaatcaacaacggcttcaaacgtctcaccaacgtgatcagccatatattcagccttcttcatcgaatcaacgtcgcgttcagtatcaatcccccgccgttcatgatcagaagtcgtttccgcaatatttggtaggttatcccgataacgtgcccgggcttcttcaccagtgccgttttcagcataatggcgaatcaaacgatgaaccatcatatctggataccgccgaattggtgacgtaaagtgagtataatacggtgccgccaacccaaagtgaccaagcgactggtcagcgtatcgggcctgcttcatgctccgcagcatcatgactgagaccatggcttcttcgggcttaccagcaaccttcttcaaaacgtcttgaagcatcttcggcttaacatccttagaactccccttgacactgacaccaaagttagtgacgaattcaaagaaactaagcatccggtcactatcaggcgtttcatgtacccggtagataaacggtaccttaagttgactatagttttttgcaaccgtttcgttggctgccaacatgaaactttcgatcattcgttcagctaagccacgtacccgtaattgaatgtcaattggatgaccggcttcgtcaacgataattttagcttcgttatcatcaaaatcgatcgcaccacgatgccgccgatgcttgtacaagatacggtgtaagtcgcccatcgtatcaaacatgtcgaccaagtccgcgtacttttcacgagtcttggggtcatgggcttcgagaatctgattaacagcgtcataagtcatccgggcgtgtgaccgaatcacactttggaaaatcttatggttaacgatttcccccgtttgatcaatctccatctcacaactcatggctaatcgttcaacatcaggatttaaggaacaaatcccgtttgatagccgccgtggcaacattggaatcacacggtcagttaagtaaactgacgtcccacgtttgaatgcttcccggtctaactcagagttctcggtgacataatggctaacatccgcaatgtgaacgcctagatggaagttcccatttggcaagcgccaagcaacaaccgcgtcatccaagtctttagattcggcgccatcaatcgttactaatggctggtccgtaatgtcgacccgaccaactttttcttcatcagtcacgtaatccggaatccggttggcttcatccgtcacttcttctggaaacactgatgggacgtcgtgttggtagaccacttgtaagacgtccatcccaggatcatcaacactcccaatgacctgcttggcaatcccaatcatccgcgttggatgctgagcgtcaggataagcagccacttcagcaatgatgacttccccctcagtggggtgtaagccctgatcagtgattaataactgatatttggataatttcttatccttaatttccacagaaccaataatcccgtcttcatccgtacttggtgtatacgcaccgacaatctgggtatagttccgtttaacgatgctgacaattttaccttcagggccgcggtcggaaccgggacgggctggtcgaatgatttcaaccgcaacatcgtcaccggtaatggcaaactgcgtgttgtccggattaatgtaaatatcaggcaaatcgggatcgtaacgaacgaaaccaaagcccttgtcattaccatgaaatgaaccttcaacagtcttcgtttcctggaccagcttgaaatgatcatgatcatcggtactaactaattttttacgttccatattcgcaagttcctttactagaaaagtaaacgccgttgcgcctgtaaaatgcaattcatccgttagttgttcaacactatacgtgcgatcgggatgagcttgcaaaaaagtcaggatttgttcttgtaagtttgcttctgacattatttacctcatttataaatagtttttaaatatgttaaaacatcttgttccaattggtgatgcgcactgttgacggtaatcacgtgtccagcatcagcataccaatgaaaatcaactggtacttgtggtaattgatcacgtaatcgtcgcgctaccgtcgcatcaattaattcatcttgcccaccctgaccaatgaagaaaggttgggtcacagcgctgaggtgactcgtaacctctgtcgtagtaaaggtattgactgcctgcaattgccgctgaaccagttccggcaacgtcattaagatctgttcacgctcggtaattgagaattgactgtgcgccagttgatggtgactcagcgtgataaacatttcagcaacgtcactacgattaccagcaaatagtggtgaactaaacgtgccaccacctagcaactgaggatcacgttccaaggccgccgtcgcaaaaataccacctaatgataagccaaagatactaattttagtatagcctttttgccgcataaatgatattgcttgttgcgtatcttgccaccattgcgccggcgtctgtgcgagaatatctcgtggatcatcagtcgcgtgtccactgaattgggggccataaactgtataatcttcccgttctaatgctcgtgctaacatccgcacatcattggcacttcccgcataggcgtgcaataaaatgacggcatgttggccatgttcaaagaaaaacggttccggttgtttcagcatcattacaccaccttaaaaaaaagcctcctgaaatcacaggagggcggtcaattacttcgatgagtaccatgctagagctaacgccaagataaagaatgcgattcctaataccacggttaccttctgcatgaacgcttcaaaaccgcggggcttctgcttggcaaacaagtcatcagcaccaccggttaatgaagacatggcatcattagttttggatggttgcatcatcaccgcaatgataatcaaaacggaaacaaccagtattaacgttaacaataaattatacaagaaatgtgcctcctaaagcctccgctatgtctataacaatttaacatattttgccttatttttccagtatcctgaacaattcgttgctttgtttagtgctcagggcgtcgcgaccgttaaatgtgcgatttgatggcgcacccacgcacggttatcccggtcagtcaagataattaaggtatcaccagcccgcatcaaggtgtcgccatgcgggatcacttgacgctccccgcggcgaatagcgatcaataatgactctgctggccatttaaaatcacgaacttgatggccctctaacttagagccttcaaagatcggcaattctaaccgatcctggataccgctatgttccggtaaccgcggctgaattaacttctctagcaaagcctcataaatcggagcgccgcctaagagatccacgactaagtaggccgtcatcgaaacgactgctaatggcatcaagtgatgtagtgtcccgaccatttcagtaatcaataaaattgcggtaaacggtgctttaccaatgccggcaaagtatccagccattgcaaaaataataaagttcggaatcaagttcgtcggcatccaaccaacggcaaccatgaactgggcatagattgcacctaagatggcgcccagtgacaagattggcaagaagatgccccccggcaaaccagatccatatgaaatggtagaaaaggtaaaccgtaacacgaaaattcctaacaaggcgagtaacgctggcgttactgcggccaaattcaaaataacagcattgccgcctcctaatagctgcggccaaattaatccaatcggaatcaccagtaaaaatggcaccaagccatccaaccaactgggcaaccgcaacttggcataccaatttggcatcgtcagcgtcacgttttgatatagataaccgaaaataccgagaaaaatcccgagcccaatcagattgccatattgactcaacggaaggttatggccgtacggaatgtgtaatactggtacaaggccaaaaaaattgagcgaaataaaattactggccatcgcactaactaatgcggtggtccaaatgattggtgaaaaattatgataaacctcttccagaacaaataacgtactggcaatcggtgcgttgaaggccgctgaaaggccagctgctgcaccaccggcaatcaaggagcgtcgatctgatcccgtctgtttgagtttcgacgcgacaccctgaccaatcgtagctcccaattgaatcgaggggccttcgcggccgagaaacagtccagaaccaatgcccagaataccaccgacaaacttgcgccagagcactgaccaccaactataatcaagctcgccagctaattgaccctcaacttgtggaatgccagaccctttaatattcggttcattcttaactaaccaacccacaaagaacgccacagccacagacaagcctatccatggaaagagcagtagccaatttgtatgaatttgtgcgtacacccattgaacgaacctcagtccctgctcgatgctgaaacgaaaaatactaaccacgatcccagcaatcacaccgacaattaatgcccggccaatcgagctgaaccgtgtaaagtcaaaatgttgttttgcaatgtgcggccgctgtgccaccatgagttccccctcttaatcatgataatcgttgtgcaatcacttgctggacggccgctaacgtcacgggcgctccaggatgtaatgcctgaatctgctgtggtccatctacgcgtaataacaaacctaataacagatccttttctaagtcgtcagtttgataagtttccttaaatccagccaataagtcagtatcatcattaaatgcttgcaaaattagcgggactaattccgtttgttttgcagcttgatgggcggcactgaatcgctgtaaacctaattcaccactagtcacaattaaattcccacccactagattgccatgaacaaattgattaggcgttacggtgtgtacttgtagccaggccgtacgctcggcaacaaagtcggggcccagtgtatcccactcggttgattgggcagcggttggcccaaatgcaggaacttcagtattaagtcgcgtcaacatcgtcccaatctggcgccccagtgttgacttagcaaggggcttagccgttgcgcaaaattcagttagcgtcagaccttgtagtggctgataaatcacgtagtagaactggtacttatcaaaaatgaagcccgcatgcaatagacgcggagcacccaagctcaatcgagccatccgggtcagtccaaaacgttccgcctgataataggcccgagtttgggggataacctcactgggtggaaaaatcgcgatttgggtgggtccgaccgtaaagcgggcggccaacttatccgcaacgggttctggcgttttataaggctcattttcactggcataaattttttgaatcaccggttcaaaagcaccggcattcagttgcagtccttgccaatcagaccactcattaatttgttgctgaaagtcatccattctgctcgctccttactcaaaatacgcatgtttctattctaccacgactcgtccgtccctagaccctaaactcaaacagatgttccttaaattatgtataataaaaacgccgtcccatcggaacgacgttttcattagaacttcaaattacttgctagtaatggtgttccgtgcagcttcgtctaagttgtagaaaccgtggatacctttgtattctgaagtgctttcaagttggtcttcgatccgcattaattgattgtatttagcaatccgttcagtacggctcattgaaccagtcttgatttggccagcgttcattgcgacaactaagtcagcaatggtcgtgtcttcagtttcaccagaacggtgagaaacgatggcagtgtagccagcttctttagccatttcgatagcttcaacagtttcagttaaagtaccaatttggttaaccttgattaagattgagttagcaacgcccatcttgataccctttgcaaggtagtccgtgttcgtaacgaataagtcgtcaccaacgatttgaactttcttaccaagcttggcagttgccatttgccagtcttcccagttgttttcatccaaaggatcttcgatagaaacgattgggtacttgtcaacaatgctgtcaagtaagtcaacgaattcttcggcagtaaatgattgaccattttcgccttcaccctttaagtcgtacttgccagtttcttcgttgtagaattctgaagcggcacagtcaaaggcaatggcaatatccttaccaggcttgtaaccggcacgttcgatagcttcaactaagatttcgaatggttcttcgttgttcttcaagtcaggcgcaaaaccaccttcgtcaccaacggcagttgagtaaccgcgttcgttcaagatcgctttcaagttgtggaaagtttctgaacccatccggatagcttctttaactgaagaagcgccaacaggcatgatcatgaattcttggaagtcaacgtcgttgttggcgtgggccccaccattgataacgttcatcattggtgttggtaaaacgtgagcgttgaatccgccaaggtagttgtataaaggcatttcaagttcgtcagcagcagcacgtgcagcggcaatggaaacacctaagatagcgttagcgcctaacttagctttgttaggagtaccatctaacttgatcatagcttggtcaatggcacgttggtcagttacatcgtaaccaacaatttccttagcaattaacttgttaacattgtcaacggctttagtaacacccttgcccatgaaacggcttttgtcaccgtcacgtaattcaacggcttcatgttcaccagttgaggcacctgaaggaacgataccgcggccaaatgcgccactttcagtataaagttcaacttcaacagttgggttaccacgtgagtctaagacttcgcgagcataaatatctgtaataatagacattaatttctctccttaaaattggcttgttatttgtttcacacttattgtagaagtttgtcaatcaacttgcaataactattattagttattttgataattaacaagttccaagaatgaatcaggttgtaatgaagcaccaccgactaaaccaccgtcgatatcatctttgcccattaattcgttaacgttggctggtttaacactaccaccgtattgaatccgaactttatcagcaacttcttgtgagtaaaggtcagcaacagtcttacgaacaaccgcacaaatttcttcagcttggtcactcgtagcagtcttaccagtaccgatggcccagattggttcgtaggcaataaccaatgaacttacttggtcagctgataagtctttcaaagcagccttgatttggcctgaaacccatgattctgcttcgccggcttcacgttgttctaatgattcgccacagcaaatgattggcttcatgccgttcttgaagatagcgtgtgcctttttgttaatgtcttcgtcagtttcgtggaaataaccgcgacgttctgaatgaccaataacaacgtaatcaacgcctaagtcagctaaggcagctggtgaagtttcaccagtaaatgccccagcatcttcaaaataagcattttcagcagcaatctttaaatcagaacccttggcagcttcaaccatttcctgtaagaaaagggctggggcagcaacgactgattcaacttttgatggatctggtaattgatccttaacagcattaacgaaagctaaagcttcgctagctgttttgttcattttccagttaccggcaataataggtgtacgcacgataaaccttcctttcggagaacagattatttttcagaaatagcagcaataccaggtaattccttaccttcaaggtattcaagtgaagcaccgccaccagtagaaatgtgggttaacttgtcgccaacgccaagttgcttaacagcggcagttgagtccccaccaccaacgatggtcgttgcgtctgataaggttcctaagaacttaccaatttcaagcgtacccttggcgtagttgctcatttcgaagacacccattggtccgttccaaacaacggtcttagcgtcgcgtaaaacatcttcgaattcttcgattgacttaggaccaatatctaaggccatgtagccatcaggaattgaaccttcaacaaccttgctaggaacatcgttatcaaacttttcagcaacgattgagtcgctaggtaagactaacttgtcgccagctttttcgatgattgacttagccaattcaatcttgtctttttcaacaagtgagttaccaatgcccatgcctttagcagcatagaacgtataagtcatcccaccaccgatgatgatcttgtcagctttgctgattaagtgatcgataacaccgatcttatcagaaaccttggcaccacctaagatagcaacgaatgggtgcttaggattgtcaaccgcgtcacctaagaacttgatttccttttccattaagaaaccagcggcaacttgatccatgtttgaagcaatcccaacgttagaagcatggctccggtgagcagtcccgaaagcatcgttgacgtagacatcaccaagtgaagcccagtacttgcctaattcaggatcgttaccagattcgcgcttaacttgttcgccgttaacaacgtcttcaaaacgagtgttttcaacaactaagacgtcaccgtcgttcatgttgttgatggcagtttcaagttgttcgccttcagtaacagggacgaaggtaacaggcttgtttaataagtttgaaagacgttctgcaacaggacgtaagcttaagcccttcttgtcgtcttcgctcttaatccgacctaaatgtgagaataagatggctttgccatcatgttcaatcacgtatttgatcgttggtaaggcagcgacgatccggttgtcgtcaccaattttgccgtctttaattggaacattaaagtcgacacgaattaaaacttttttatctttaacatctaaatctgaaacgattaatttagccaatgttaaaatcctcctagaattcgtgactgctgaaattaaaaaaacggcaagaggagttttgcctccccccgccgtcaaaaccatatgcggttttaaagttcttaactatctaatcaaatattagagagtggcgaacttcaataaagtacgtaccatttggcaagtgaagccgtattcgttatcgtaccaagcaacagtcttaactaattggttgtcaccatcagaagtaacttctgtttgagtaggatcgaagattgaaccgaaagtagtaccgataacatcagatgaaacgatttcgtcatcgttgtaaccaaatgattcgttaccttcagtatgcttcttgattgcggcgttaacttcgtcagcagtaactttcttgtctaagatagcaactaattcagttaatgaaccatcaacaacaccaacacgttgtgcatggccttgtaatttaccgttcaattctgggataactaagccaagagccttagcagcaccagttgaatgaggaatagtgtttacaccggcagcacgggcagcacggaagttaccaccacgtacagggccgtcaagtaacatttgagttgaagtgtaagcatggatagtagtcatagtaccaaccttgataccgaattctttgttttcaaagaatgctaatggtgcaaggcagttagtagtacatgaaccagcagaaacgatacggtcatctgcagtcaagatgtcatcgttaacgttgtaaacgatggtcttcaagtctgagccagcaggagcagaaatcaagacacgctttgcaccagcgtccaagtgagcttgtgacttagcctttgaagtgtagaaaccagtacattcgagaacgaagtcaacaccgtcgttcttaacccaaggaatattttgtgcttgtggttcagcataaacacggtagttcttaccgttaacaacgattgaatcgtcggttgctgaaacgtcagcgttcaaagtaccatgagttgagtcatacttcaaaagatgagccaacaatgcaggtgaagttaaatcgttaatagcaacaacttcgatatcacttgacttttcaccaagttctaagatacgacggaatgctaaacgaccgatacgtccgaaaccattaataccaatttttacagacatactagaatttcctccttgtggaaataaaaatagttttattttaaaaagcaacttcactatagaagattacttttttaaaatcaagttagccgcaccctcatccgtgatcaaacacgtctgtttaggtgcaatgttcttcatatacgcggcaattgcggtggcttttgaagccccacccgcaatggcgagtataatctcccgatgggccagttctccgatttgcaatccaatccgcggaatccggtagaccacgttacccttcttatcaaagaagtaaccaaaggcttcaccaatcgcttcacgactgcgtaacaccttgatctgatcctcagacatattccggcgatgggccattgaaatagcttcaccgatactatgcacgaccacgttagcttgcccgataatcgccagcacctcttgaatacttggttctttgaggagtggttcatacgttcgttcactgacctgttctggtacaaacaacgagcggaacttaccgccagtatgttgtgccatttgtgacgcgatggtatttgcttgaatcgcaaccgattcaccaacaccaccacgcgccggaacaaataacaaatcacgtttatcacctaatttattagttaagtgacttgccacatgttccatggtatgcccacccataacagcaataatattacgcccttccggcaataattgctgtaatagctggttcacttcttcgcccatggtcccaataactttcaactgtcgatcggaatcaccagaaacgatgatgcaacgcttaatattaaagtattgcgccaactgtcgttctttctggcgaatgcccattagctcatccataaaatgacttagtcctactaacacgtcctgaccttgctgggtaacttgcatgcccgatttgtttgtcataatcaaatctagcttccgcaatgtatccgtttcggtccgtaacgtccgttcgctaacacctaacgtctgagctaatagccgacgtccaactggggccatccaattaatggttcttaatactaagtaacgacgactcagcatgtcaaccatatctggggcaattgcctcaatccattgaatatctgaatgcatggcatccaacctgctctctagtgggacgggtctggtccagctatgtcgaaaagcgacccaaagacttcaaaaaacaaagcacacaacgcaaattcactaagaaatcaatgttgcatacctctcttaccacaacatgaattataacaggttcataaggtggttgcaaatgaaaccccaattaaacttataaccgactggtccaaatggcgcgttaaattatcgttcggttctcaagtattgttttcgccttgatgacgacggaatattaagattttcgcgatatttcgccactgtccgccgagaaagttcgacattttccgcattaagaatctgaacaattttttggtctgaaagcggtttttctttattttcctgttcgatcaaggtcacaattcggtgttgaacactgtcggccgaaacgattttgccaccagtgggacgtttactgaccgctttggtaaagaaacgtttaagttcaaacataccgaagtccgtttgaatgtactttccattaatacttcgactgattgttgattcatgcacttttaactgttgggcaacatctcgtaacaatagtggccgtaaatccgtcgttttttccaagaagaagtctgcttgacgctcgataatggccgttcccactcgaaaaatggttgcctcgcgttgctgcaaactgttagcaatccagtcatactcacttttcttttctttcaaatattccgtaacttcctgatcatcatgctgccccatctgctgataataccgactgcggaatttaaccaccggttgagccatggatgcggttcgcaatgccagctggcctccctgattcgtcaccactaaatcgggaaagatgtacccggtcgtctcctgcccgattgccgcaccgggtacgggtgttagtgttcgcacataatcataaatacttgaaatgtccgcaagcgtcacctgatacttcttagccaacaagtcccattgtcgattaaccagctcgtcaaaactttcttctaagacaatataggctaagttcggtgcatggtcatcattttctgtctgcaacatcagcgcttcttgcaagctccgggccccaacacccggcggatcaagttgttgtaataaggtaattgcatccaacaactcaattggcgttgccttagtttcttgccgaacttgcctctcatcaatccgcaaataaccattcacgtcaacgtactcaattaaataaaggacaatctgacgcaaatgggtatcacgcatcgttaggtgaatctgatccaacaagtattcaaataacgaatgctgattagaggtcgacacacgctcaatgaaatccgccttagtggttacatttttggctgcgttcaaactggcgtgattattattccaatttgtatccacatcgatcaatgggttttctaatgctttttgcgttagaaaatctcttagttcttccacattaaactgcaacatctgaatggattgttgtagtcgctgggtcatcgctaacttctgtgattgccgctgttgctggcgaaatcctggtcccagtgccataaaaatacctccctgaataaatttttatgtaaaacccttgtgtttttatccattattcgctagaatataatatgttgtttaggcgcccgtggtgtaatggatagcacgtaagattccggttcttgagatgggggttcgattccctccgggcgcatcagtagctgagaaatgattctcagctttttttgtgcatttatttaagtgacaactactggactataccagtcacatctccatatagtaacttaatttaaaccaaacaacaagtaatatcctttcggggtcagtaatagtacctatacccgctcgtccaagtaaaaataatcaaaaagtaatcagttcaagtaaaccatataccagtgtagtcgtatagtagatttaataacagctaaacttacactattcaaataataattactacaattgttattatattatagaatcgttttaatcatggtaaatttcattcatgcatccgatactgattaattcgttgcgagcaacttgagtccagcaacaaggtcaagtcgtttaatatgtcggctcacgtgcgaatttccaacttctattagactcatcgttgtgggtcactatcagtaaattgattcacctactatcgcgataataaaattatgcgggtcgactacttttaaatcaccacattagtgctgaatatgcaagttcattactgcttaatcttgaatcattattataagagaacatcgttttcaagccaaggtagacgcaacacttaatccaaggcctactaactaaaatcgtcgaaaaaaaagagattgggttcacccaatctcaagccgtattatgatagaaacctaagtataccacgttaactgcataaacggaattctgtttttgaggtttttcttttgaccttcactgaccttagcggtaaactacatttatattagcaatcagctaatcaaataatgcaaccttaggaggctaacaaatcatgtatccagttcctacagttattgaacagtcatcacgtggcgaacgtgcttatgacatctattcacgactattaaaggaccgtatcattatgttatccggtcccattgaagataacatggcaaacgccattattgcccaactactcttcttggatgcccaagattcaggtaaggacatctatctctatatcaactcaccaggtggtgtcgttactgccggcttagcaatctacgatacgatgaacttcatcaaatctgatgttcaaaccatcgttatggggatggctgcttccatggccagcgtcttagcttcatctggtactaagggcaagcgttttgctttacctaactctgaaatcttgattcaccaaccatctggtggtgctcaaggtcaacaaacggaaattgaaattgttgcggaagaaatcttgaagactcgtaaaaagatcaaccagattttagctgacaactcgggacaatccgttgaaaagttgaaccatgatactgaacgtgataactacttaagcgcacaagaggctaaagactacggtttgatcgatgatattatggaaaacaacaaattaaaataagctaatatctttgactgggctaactagacgttggcccagtttttttgctcgttttcttgtcattcgttttgcaatagcccatactgcacataagcagggattactacccggacaatattacttgtccttgaacttaaaagtaaaaaggagtctctataatgacaaaagtctttattgctggtcagcttccagcccaagctaatacgttacttttacaaagtcagttagtcattgatacttataccggcgataacctgatcagtcacgcggaactcatccgtcgagtcgctgatgccgactttttgattaccccactctcaactcaagtagatcaagatgtcttagaccacgccccacaccttaaactgattgctaattttggtgctggcactaataacatcgatatcgcggcagcagctaagcgccagattccagtcacgaacacgccaaacgtttcggcggtcgcaaccgctgaatcaacggtcggtttgattatcagcctagcgcatcgtatcgtggaaggcgatcacttaatgcgaactagcggctttaacggttgggcgccactattctttctcggccacaacttacaaggcaagacactcggcatcttaggccttggccaaattggtcaagccgttgccaaacgattacacgcctttgacatgcccatcttatacagccaacaccaccgcctaccgattagccgtgaaacgcaacttggcgcaacctttgtctcccaggatgaacttttacagcgtgccgacatcgtcactttacacctgccgcttaccacacaaacaacccatctaatcgataacgctgcttttagcaaaatgaagtccacggcgctcctcatcaacgccgcacgggggccaattgtcgacgagcaagcacttgtgacggcgctgcaacaacatcaaattgctggcgctgcactcgacgtctacgaacatgaaccgcaagtcacacctggtttggccacgatgaacaacgtcattttggcacctcatcttggcaacgcaacggtcgaagctcgcgatggcatggctaccattgtcgcggagaatgtgattgcgatggcccaacatcagccaatcaagtacgtggttaacgacgtaacaccagcatagaccaatcagtgtagttgtcttgcgtgacaactcaagcactgtagaaccattcgtcgaaataaataagcggtccacttcgattcgtcaagacactctgacaagtcgaaatggaccgctattttgttttgatcaaggcaacgtatggacctggcgctcctactaaggtaacagctaaacgaccagttaccatgaacgtccctcaatcagttaattatttggcaatataagcatacttataattccactgtgtcccagcagtattatgaataataccctttacctttggattttgtaaataagagtataccgtctgatacaatggcgtaattccttggtccttcatgatcgtcttctcagcgttgatcatatcttgccaacgagcactagtatcattggcatcctggttttgggccttgttaaccaacgcattgtacgtgctgctgttatattttccgtaattataaccactattattagtcataatttgcaagtgcgagattgggtcgttgaagtcagcaccccaaccactgagataaaggtcaaaatcaccactttgagcacgacttgaagctacctttgatggaatgttggataagttgaccgtcaaaccatcgagattcttttctaatgctgatttcaagtattgtgaaatcggcttattaggttcgtcattagaagctaataactgaatggacaatttcttaattcccgtttccttaaggccttgtttccataacttttgtgccagtgctttgttatatgaagttgaattcttaaccgttgattcatctgcaaaatccttaccagttttagcgtctttaactaaatcctgaggaacaaacgtctttgagaccgttgatgcgtcaccaatcacattctttactaacgtcttgcgattgatcgacaatgaaattgcttgacgaatcttagcgttattgagcgcctttttgattgtcgcattactgtcttggaaattataaaccagaaacgcggtgatagaataagggtacgtggtatagtcagaactgctcttcatattcttaacttgttcactcgctaattgcgttagatcaagtttcttttcttggaacaagttcaatgttgtcgtagtactctcattgaccgtgtagttgatcttttgtaggtggacagctttcttatcccagtactgattattttttacaaactgccagccattattagttccagtccagccagtcaacttaaacggcccactgtagagcatgtactgagccttagtggcatatttgctaccccattttttgaccgctttctcactaattggtccaaacaacgggtaggtcattaacttcttaaaataagtaattggcttgtcaagagtcacaataaaagtatgttcgccttgcgccttgacgcccaatgtacttggtgactttttcccagcgacaatttcatccgcattcttcacccctgagaagaggtaggcatactgtgacttagttgctggggtgacggtccgtttccaagaatagacaaagtcttgcgcggttatcttcgaaccatcgctccacttcgcattgcgaatcgtaaaggtatacgtcttgccatcctttgaaaccttagtggacttagctaatcccggtgtaatgctaccattctttcctaaccggtataagctttcaaaaatattacccgtactgccatatcccgacatattggaaatatcgattgaatccaatgaactagggtacgacaagtttaaaacctgactacttgcatacttgccattaccagaagactggctattgtgcttcccacacgcagccagcaccgtcactaatactaggctcattaccactgctaacactgatcgcttcttcaaacttctcgcccctttacattcccattttgatgtgttgatctacttattcccatcggttgtaacaaaaaacgcctgttcagaatctcgtcagattccaagcaggcgtttcaaaattaacgatttgagctcaatcccgttatttttgatgcagagacgcttgtaattcaacgcaaatagccatgttgtttgattcacaacatgggcagcacatcatcatttgcattgttgatttttgcataattacgtctctccgatttcgataagatgtgttcagtataaatagttgcacttacttttgtcaagtgcttttcgagtatggcgaacgacaatcaatccatttcaacccaaaaaagccgctaacaccatctaaaatggttagcaagcttttcaacaaaactcatgcttaagccatccttatcgacaactaagcatctttttgtaattgttccgcaaattgattgattttacgcagccgatgattgattccagacttagaaataggcccgcccggaacaagggttcctagttccttgaggctaacttcacgatgttccaaccgggcaacagcgacttcttgtaattttggtggtaactgttgtaatcccaccgtagcatcgatcaataaaatattttcaatctgtttgctagaggcattggcaaccttatccatgttggcattctcacagttaaccaaccgattgaccgagttacgcatgtcccgcatgattcgaatatcttcaaacttaagcatggcattggtcgcaccaaccaacgacaagaagtcggcaattttttccgcttccttgatgtacgtaatgaaaccaccacgccgatcagtcgttcgtgaattcaagccatactgattcatcatctcggagatcatatgattatgttcctcatacagtgagtaaatttccaaatgataccgggaagtttcaggattattaaccgaaccgcccgctaaaaaggcgccacgcaaataagaacgcaccgcagcatcatccgttaacacttcagttggtgccacttcaacgatttgataatcctttaaaatacccaaatcagcgagtaccatgtccgtaccggtcttcaatcgtacgatgtacaaattattcttatttaatttcattttgcgccgaacaatcaattcactatcgacgtcataaaattgtttgagtagccggtaaatacgccgcgcgatggccggattttccgtctgaatattcaaaatgaagtgatgattagcaatgctgatcgccccattcattcgaatcaaagccattaattcagccttagcattctcgcgatggacagcgaggttagtcaattctttcttaacgtcactggcgtatgacatgccacgacccccttatctgaaaacgtcggaatgaccgactagattcattaattcagcgacaacttggtcgccatcatgaaaggccccattatcacggagtttcaagaagttcgatgagattacgcgacagttttgttcacgtaacccccggaagtcatgactcacttgctttgaaacttcgttaaacttatgaaaatccatgtaatcttctggcactttttcggtgttaactaacaccgtattaataaagttctgccccaaatggcggtttaagacccgtacatgatcagcatcggagaaattatccgtttcacctttttgagtcataatattacaaatataaaccacttctgcatcagactcacagacggcccgaccaatatttccaatcgttaggttcggtagaatactggtaaacaaactaccgggccccaaaacaatctgatctgccgccataatcgcatcaataactggttgaactgcttgtggttccttaccattcttgtcagtgacccaaacgcgttccaatgacttatgggccgcggtaatttcggcttcacctactaactcagtaccgtcactaaacttaccatgtagcgtgagtgcctcgttggctgccgggtaaacatgaccatctacttgcatcatatttgataattcctgcaccgcgtcaaacaccccggatttcatttccgttagtgccgcaataattaaattaccaatcgcatgacctgcaaaaaattgatcatcaccctggaaacgatactgaaaaatatctttatacaaatccggccaactcgacaacgccaccattacattacgaatatcaccaggtggaaccacgttaacgtaattgcgaataatgccggatgacccaccatcatcagccaccgtcaccactgcggtaatatcgactgcctgcttacgcaagccgttcagaacaaccggcaaaccggttcctccaccaatcaccacaattttaggccgctgggtcttaaatgtgtattttctcatgagcgattaacagtttcctttcgtttctcaatatcacgatgactgatgtgcaccttgtagtgcttagccagcgcttcaccgatacgttgcgtcaaggcaacggaccggtgttgaccgcccgtacagccaatcgcaatcgtcaaactactcttgccctcggcttcatagccgggcataatgctttccagcatactcaagaactgctggtagaaagcttccgtagctggttgctgcataacgtaatccgccacaggtttatctagtcccgtcagcttctttaattcaggaatgtagtatggattaggcaagaagcgcacatccataacgatatctgcatcaatcgggagtccgtatttaaaaccgaatgatagcatttcaatatgaaaagtctcatcctgatccgtttcgaatttatcaaaaatcgattcgcgtaattcacgtggtgtcaacgtcgacgtatcaatgacgtatgaagcccgatctttcaatggcgccaataattctcgttctttgcgcacgccatccatgacgcgaccttccatggctaatggatgggaacgccgcgtctctttataacgtgacactaattcttcgttggaagcatctaaaaacagaatccgggtcgacacaaagtccgtgttgtctaagttagccaacatatccataatttcgtcgtaaaaagcccgcgagcgtaaatcaatcactaacgctactttctttattttacccgactcctcaactaattctgagaacttcggtaataacgctggtggcatattgtcaatgcaaaaatagcccaggtcttcaaagctttgaaccgcaaccgtcttaccggcaccgctcatcccagaaataattactagttgtaatgattctgccatgctgtattggccccctctagtccatattgttgttagtataacacaccgggtgtgtcatttctactgacgtgccacttcgacccgccatttgattccaaacagtattacattaacgcgcaaaaaaagaccccttaacaacaccctgacaccaccaatagtgagcgccaagtatcgctaacgagtcaatactgccaagctagttacgccgagcaaaagcaatcaagattgcgttgatgccaaaaactgcaaagtagaaactaaccagtacgttgaaactaatcacagcaatcattggattgattactaataagattcccaatgccaaactaataatatccaagattaaagatagaacaaaatacccggttccaaagacgcgtagatgtgagactacggtcagccgttcaatcgaatcgatcaagaaccaaaaggcaaagacgtaaccgagtaccagtaccccagtcggtgcgtggaataaaaataataaccccactaaaatatcaataatcgcaaacacaagggcaaagtttgcccgcaaccctgtttcacggcgtagttttgtgtacccaccgattgtggtgaccccgctaataattgcggcgatggcaaataaaaagactaaacttaaaagtgctgcttgtggttgcttgatgacaaagtaagcggcgatcaagaaaacgatccccgtcatgaattcagtccaatcaaacccccagcgatgatcattaaacatacatcaacatctcccatatccgatattaattccatcttaccagttaatgtaagagtttccaatttttctgatagactttatgttagcttaatgctttttcaaaatgtcaatagcattaaaaatggcctctaaatgccgagtctccgccacttagaggtcatctttaaaaataatatcaatggtcaaattgataagcattaattaatcagtggtttcagattgataggctgacaattgcgtttgtgcccgttgcaattcttgtctaatctgatcaaaaccagtaccacctagcgaatgccgccgttccaccgcaacttttgcgttcaaatcatggtagacatcttcttggatcagcggtgagattgactgatattctttgagtggaatatcctgcaacggccgctgttttttcaagccatccaagacgagcttccccacaatggcatgggcctcccgaaatgggattcctttgtttgcaaggtaatcggctagttcggtcgcatttgagaaatcgttagtcgtggcatcagccatccgatcttcattaacggtcagcgttgccaacatgccggtgaagacgtggagactcgttaacacggtcgtgaccgtatcaaacgccccttctttgtcttcttgcagatccttattgtaagcgagcggaatccctttcatgacagttagcaatcccatcaagttgccgtaaacccggccggacttgccccgaattaattcggccatgtcagggttcttcttttgcggcataatcgaactacccgttgaaaactgatcgctcaaactgatgtacttgaattcataactgctccagctgacaatttcttcacaaaaccgtgagagatgcatcatcaggatcgaagcattgctgagaaactcaagcacgaagtcccggtcagaaacggcatccaaactattatgatagacttcactgaatcctaatagtttcgcactatattcccggtcgattggaaaagtcgttccagcaagtgcagcggctcccaatggcgaaatatcggtatgcttcaggttaaactcgaagcgttccatgtcccgcttgaacatttggtaataagctaacaggtagtgcgcgtacgagatgggttgggcgtgttgcaaatgcgtgtaccccggcatgaccgtctccacgttctcactcgctttatcgaccaataccgtttccagttcatgtagccggtccaatattagtggtaattgatgcttcaagtacaagtggaaatccgtggcaacttggtcattccgcgaccgggccgtgtgcaactttccagcgactggcccaatctcttcggtcaataatgactcaatattcatatgaatgtcttcgttgaccgttgaaaattccaacttaccttgtttttgacgctcagccaaggtttccaaaccagcaacaatttgatcaacatcagcggcaggcaaaataccagttttcttcaacattttaacgtgtgccagtgaaccagcaatatcttctgcggcaagcaactggtcaaagctaattgatgccccaaagtcatcaacatacttagcacccgtttcggtaaaccggccaccccatagcttcttggtactcattaggcgtgtgccttatcagtcttagcttcggcctgagccttcgcttggacttgggcattaacttgcgttggtaagccccatagcttaatgaaaccaactgccgcttgttggtcaaatgaatccgctgatgtataggttgccaagttcgtatcatatagtgagttgggtgacttccgcccctcagtaataacgttacccttgaagagttgtacccgaactaccccattgacgacttgctgagtttgctttaagaaggcaaccatcgcttccatcaatggtgagaaccaaagaccgttgtagatcgtatccgcaagcttttgttcaatgattggcttgaagtgagctaactcacgctcaaacgtcaaatcttccaaatctttatgtgctttgagcaataccgttgcagctggtgcttcgtaaacttcccgtgacttgataccgaccaaccggttttcaatatggtcgatccgaccaattccatgttcaccagcaatctgatccaacttgatgattaaatcagctaggttaagtgattcaccatctaaagcaactggcaccccagcttcaaaagtgatttccaaagtcgttggcgtatccggcgtatcagctaaggccttcgtccggtcaaacgcatcggcaggcgcgccctgccatggatcttctagaatgccacattcattggcccggccccataagttttcgtcaatcgagtaaggactgtccaaattgattggtacgggaatattgtgttccttagcgtaatcgatttcttcttcccgtgaccagtgccaatcacgtacaggcgcttcgatcttgatatccggtgcaagagcatggatagcaacctcaaaccgaacctgatcattacccttcccagtacaaccatgggcaattgcaacagcgtgctcttgcttggctaatgtgactaacttcttagcaattaaaggacgtgaaagtgctgagaccagcgggtattcaccttcatacaaggtatgaccttgtaaagcaattaacgcatattcttcagcaaattcttgcttagcatcaatcatatatgatgaaacagcccctaattttagggccttttctttgattgcatccatgtccttgccttcaccaacatcaattccgcaggccacaacatcatagcccttatccttcaaccaactaattgcgaccgacgtatctaaaccaccagaataagcgagaataattttatcattttgtttgaccattgatttgtacctccgaaatttttatctttgcttttatcaatgacagtatcgtaccacccaatttaactttattcaataatattttaaatatattcatcatttgtgcaatattcactaaaatgtagaatttttatgcagatattcaccgaaatcagtatattttttgttatttttgaaacactaccttaatctaatcttagattgttttcccacgattcaggaccgctaagctcgcacaatgtcagtaaacagcaaaaagagcctagcttttcgttatgaaaagctaggctctttttaattggtggccggcaccaccattactttttatattttggtctattcaacgactttgcgtacaaatggatccgatgaaattccttgcgataaaatcaacttggcccattccttagctgagaataaagaatgatccttgtaattcccacagctatcgatggtcgtcccttgtacgtcttcccacttagctgggccagcaatgaattctaatgaggacttcaatgccttagcaacttcaacggtgtcatgttcaccccaggtaatcaaatgaaaaccagtccgacaaccaaatggtgagcagtcaatcacgccatccatacgatcacgtaataacccagccaacatatgttcaatcgtgtgtaagcccgccgtatcaatagcggtcttgttaggttgaactaaccgcaaatcaaaattagtgatggcatcacccttaggcccattttccaccgtaattttacgaacgtaaggtgctaaaaccttggtatgatctaatgtaaaactttctactttagccatgtacaaacaactcctctaaattaaaattacattacaaactcaagtgtagcacattgcccgttatttagcaggtgcagttgcttcacgtgctcgatcccgttctagaacgggcttcaagtattggccagtataactttcagccacttcagcgacctgttctggtgtcccagtagcaacgattgttccgccgccgtcaccgccttctgggcccaagtcaatcaaataatccgccgacttcacaacatccaaattatgctcgatgattaacacggtattacccgcatccaccaaccgatccaagacaccaatcaagcgccgaatatcttcactgtgcaacccagtcgttggttcgtccaagatgtagaaattcttccccgactgttgtttgtgcaattcggaagctaacttcatccgttgggcttctccacctgataaagtcgtggcgggttggcctaacttaacatagcccaaaccaacgtcgaccaaggtctgtagtttccgtcgaatctttggaattggttcaaagaacttaacagcttctgaagcggtcatttgaagaacatcggcaatatttttgcctttgtattcaacttccagcgtttcagaattgtattgcttaccatgacacacttcacaaggtacaaagacatcgggcaagaaattcatttcgatttttagaatcccgtcaccgtgacaagcctcacagcgaccacccttagtattaaaactaaagcggcccttcttgtaaccacgtaatttagcttcattcgtttgtgcaaacaaatcacgaatattgtcaaagacaccagtatatgtggccggattactgcgtggtgttcgaccgattggactttggtcaatattaactaaccgttcaatattcttaataccactgacactcttatacttaccaggcttttcagaattacgattcaacttctgtgccaatacgcgtttcaaaacatcgttaaccaaggtcgacttaccagaaccggaaacccccgttaccacgacaaattcgcctagtggaaaatcaacggcaatttgcttgaggttgttttcggccgcaccagtgatacgaatcttcttaccattacccggacgccgagtttcaggtagtgggataaaccgtttgcccgatagatattggccggtcagtgacttccgcgagcgagccacttgcttgggcgttccggccgccatgacctcaccaccgttttcaccggcacccgggccgatatccacgatatagtcagcggcccgcatcgtgtcttcatcatgttcgaccacgatcaacgtattccccagatcgcgcatcttcttaagtgaaccaatcaagcggtcgttatcccgctgatgcaatccaattgatggttcatccaagatatagagcacaccggacaagttcgacccgatctgtgttgctaaccggattcgctgggcttccccaccagacagcgtccgtgcagaacggctgagcgttaagtacgccagtcccacattttgcaagaatgataaccggtcgcggatttccttcaagattggtttagcaatcacgagactttgttctgataagctcaactcgttaaagaaatcgagttccttaccaatggctaagtcagagaccatcccgatatgttcgccaccaactttgacagacagggccttgcgatttaagcggaacccatgacaagtctgacaagtgagttccgtcatatactttcgcatcacatcgcgggtgaaatcactattcgtttcgtggtagcggcggtcaacattgttgataacgccctcaaacacagcgtcaacatcgcgaacaccaccaaagtcgttctggtagtggaaatggaacgtctttccgttagacccatacaaaaccgtttgttgatcagcttttgataagtcttcatacggcacatccatcggaatttctaactgttcacaagcttgcttcaacatttcaggataatactgtgaactgattggattccaaggcgctaacgcaccttcagccaacgtcagcgacttatcaggtacgacaaggtcctcatcgacttctagcttgattccgagaccttcacagtctggacaagctccctgaggcgcgttaaacgagaataaccgtggttcaagttctcccacagtaaacccacagataggacaagcataatgttctgagaacataatgggttcgccaccgatcacatccgcaatcgcatagcccccacttaatcgcaacgccgcttcaaaagaatcaaataaccgagaacggtcaccggacttcacaacgatccgatcaatgacgatttcaatcgtgtgttgttgattcttgttcagttcaaaagtttcactgatatcatgaatatcaccatcaacacggacccgcacgaaaccttcacgcttgatcttttcaaagatctttttgtgctcgccctttttctggcggacaattggtgataaaatctgcaacttcgttcgttccggtaatttctgaatccgatcaaccatctgttcaacagtttgactcgcaatcggtgtcccatcgttcgggcaaatcggttcaccgactcgggcccacagtaaccgtaaataatcattgatttctgtaacggttccgaccgttgagcgcgggtttttggatgttgttttctgatcgatcgaaatagccggactaagcccatcaattgaatcaacgtctggtttttgcatctgtcctaagaattgacgcgcgtacgctgacaaactttccacgtagcgacgttgtccttccgcgtacaaggtatcgaacgctaacgaactcttacctgagccagacagccccgtaatcacgactaatttgtcgcgcgggatggtaacgtcgatatcttttaaattatgggctcgcgcaccgtgaatgacaatcttatcatttgccaaaaaaaggcctcctcaatctcaagccagcaacctgctagctaatttgtgctttcaattccatgaccgtatcacgcagcgttgcggcttgttcaaagtcgagcttcttagcggcggtcttcatctgttcttccaacttactaatcatatctaattgttgttcacgggtcatatcatcaaagtctgtttctaagaagtcatccttcttgcccgcgtcttcagtggtcttcgtcgaagcaattagctctggaatggccttcttaatcgtatgtggcgtgatgtgatgatcttcattgtacttcatctgtacggcacgacgacgtgcagtctcatccatcgcggcctgcatcgaatcagtcgtggtgtcagcatacataatcactgaaccgtgctcattacgagccgcccgaccaatcgtttggatcaatgaacgctcgttacgaaggaaaccttctttatccgcatccaaaatcgcaactagtgaaacttcgggaacgtcaattccttcccgcaacaagttgatcccgaccaacacatcgaacttgcccagacgcaggtcgcggatgatctgcgttcgttccaacgtcttaatatcactgtgcaagtaccgtaccttgatgcctaaatccttaaagtagtcggtcaaatcttccgccatcttcttagttaacgtggtgataaagacccgttcgttgacctcaatgcgcttattgatttcacccactaagtcatcgatctgacccataatcggtcgaacctcaatcgtaggatccaataaaccagttggtcgaataatttgctggacgacatgcttggtccgatccatttcgtaagggcccggcgttgcggacatataaaccacttgattaatatgctgttcaacttcttcaagtttcaatggccggttgtccaacgcacttggcaaacggaagccataatcgactagcatttgtttacgtgcccggtccccattatacattccccgaacttggggcatcgtcacgtgtgactcatcgaccacgagcaaaaagtccttcgggaagaagtccagtaacgtatacggtggttcgccaggtttacggccatccataaaacgtgaatagttctcgataccactagtgtagcccatttctttgagcatttcgacatcataggtcgtccgctgcttgagtcgttgcgcctctaacaatttgccatcggctgtcaattctttcaggcggccatccaactcatcttcaatgcccttgatggcgtgttccataatcgcatcattcgtcataaagtgggtcgctgggaagatcgcaacatgttcacgatcagccacaatttcaccggttaaggcgtcaatctcacggattcgatcaatctcatcgccaaagaattcaacgcgcaatgcgtgatcatcccgtgaagccggaaagatttctacgacatcaccatggacccgaaaacgcccccgctggaaatcaatatcgttacgatcaaattgaatatcaacaagtttacgcaacagatcattgcggtcgatctccatgccgactcgcagtgagactacgtgatcttggtactcgtgaggatcccctaaaccgaaaatactggagaccgatgccacgacgatcacatcgttgcgttccaataatgagctggtcgcagagtgccgtaacttatcgatttcatcgttgattgccgagtccttttcgatataggtatcactcgaaggcacgtacgcttccggctgataataatcgtaataactcacaaaatattcaacggcattgttcgggaaaaacttcttaaactccccatataattgacccgctaacgtcttgttatgtgacaagattaacgttggcttattcacctttgcaatcacgttcgaaattgtaaaggtcttcccggtcccggtcgcccccaacaagatctgctctttttctcccgattcaatgccagcggttaattgctggatcgcttggggttgatcgcccgttggttggtaatctgaaactaagtcaaaatgattattatctacccgatcaatcaaacgtagtcctccttttaaacggtcacccgttcatatcatctattgataactaaatcttactgtcgcaccataaaaaataggcaagcccgcgcttccctatcacattcaaatcgcatttaattttagcacatcgaacatactttcgccattaatcggattgcggcccggccgttaaaatctgggtcgtcagcgcctgtaattgatcctgatgcgtgaacggttccgctaacatctctggtagcactgctttcaagaaatattgaacactagtcatctttttaaacgcgacaattgtttttaaactttcttgataaatatccctaaaaactggttccggattacccttttgaatttcaccaaacgactcatacaataggtcaattttatcggctaccgacaatatctggccttctagcgtttcatccttgccttctgatagacgccgtgaataagctgcctgaaactcagctggaatctcattttgcacaaaattttgtgataatttatgctcaacatccgccagcatcgtccgtagcgtcggcgttgcgtacttgacaggcgtcttaatatccccgataaaccgctcattatagtcgtgattcagcgccttctcatagagggctcgccaatcaacaatttgtccggcattttcttccacatcacctaaaaattgggcgacttcagcaaccttaaatgaatgcgccgcaactgaatgattctgatacttaaaaaaacccggggcccgttgaatcgtttctaaattacttaagctctgaaaatattgatgcattcccattgcagcccaccatccttcaatctaatttggcctaagtgtaacaaaagcgccccggggacgcaaacccggagcgctgtcgctgattagcttaactgttatgcaatattaaacttgctgatgtgaatgaacctggttcggtaatcgtaacataaacgccattaaataagaaacaatcaagaatccggccaccaccagatatggatagtgataattcatatctagtaacatccccgacatgattgggccaacgatattgccaacactcgttaaggacatgttaagcccattgattagcccctggttggcctcacttgctttcgttaatagggtcgtaatagcgggccgcaaaagatcgaatgccgaaaaaataacgagcgttgcaaccatgacagcaactttcgaatgagcctgcgtaatccagatagtgcagagcgccgcagctgcaaagcacacccgaatgacccgccgttcgccccaacgctggacaaaggtatcaaatagtgccacctgtaggaagagcgaaatcaaaccatttaaagtcaagaccaacgcaatgttgctcagactaaagtgaaagacttcattcacgtaaatactataaatgctctcaaacccctgtaagccaaaggaagacactaaaatcatcgtaaataatataataatcgggacggtccaaaatgcccgcgtcatcggatgattggtcgtcgttgtcgtggccgtaattgcttcgcgatcaggatcaatctgacgatccgcaggcaacagaatgacgagcacaatggcactgagtaatcccaatgcaccagcaacccagaacggcgtcttataactaatgccagccaataccccaccgataccgggtcctaaaatcaagccaccactaaaggccgccgataaccagccaattactttagctcgctgtcgtttggtcgtaatatcggatgctaacgccatcgccgtcggaacgaccatcgctgctgataagccaccaacaatccgggaaatattaaagacccacagctggttggttagcgcaaatagtacttccgagaccatatataagactagccctaccgttaatacgggcttgcgaccaactttgtctgaaacccggccaataatgggagaggccacaaattgtgccaatgcgaataacgcattcattattcccatatcggtagccgttaaatgcagttcatttttaataaacggcatgaccggaataactaaactaatccctaaacaaactaaaaactcactaaaaactaaaattaaaattgcgcgtcgtgtttgtcgatccatgcgacctcacctcttcaatcaattgttaaatttacaccgctttccatcatatcagggacccggattgaaagctagcagaaagtttgacaccatttacaacccttttagtcggtaaaatatcggccaatcagatacaataagcataactaaattctaaggaggccctactatggatcaagctttaactggtttcaccaatattcaacacttagaccccgaaatcatcgttgacctgcgttatgccaccaccaataactttactcatcaagtgatttacgactttaccacggccattgttcgcactggcacggcccacaaactcgccaaggcaagcgccctggttaaacaacaaggttatcggctcaaagtctgggatgcttatcggcccgtcagcgcccagcgccgtttatttgaagtgtatcctgatccagaatttgttgcccagcctaatcctaatttcagccaccaaaaaggcgtcaccttagatttgaccctggcccatcctgatggtagcgagttaacaatgccaactgccttcgatgacttcacggcagctgctcaccgtgacgctcctcgaaccgcacttcaagaaaaaaattatcagctgctggacaccgccatgaccgccgcgggctttgtcggctacgttaacgaatggtgggactaccgcgacaccgaaatggacgcttaccaacccctagccgccgatcccaacgactatgcttgaccaatcgctttcaaataatataaaggtggccgccaaacagtcaggttatgaaacccactgtttggcggtcaccttatttggctcattatttttatggattcaccagcacttattattaaaacatgctagttagttggattgttgcccgtcagcatatgcgcgtcctcgtctgacttccaggaaaccactcgagtggcagatgaacggccgcttaacccaagctaatctgtcgctgaaccatctactccgttagacttggaacaaacgttaacatagcacattcgttttgaataccatcccagcgattggcagcaatacctgaagaacggtatcggacacactccccaaacaagtttacgctaatctgaacttattccagcgggtctaagctggctgttcttgattttaacaaccagcaccttctgaacataattagtgcaaaaacttaattattccgacgatagccatgttcctgatctactgcagcctgcgccactaaattcaagtaattaaacggttcatcaaagttgggtgagaatagcatatccatgaaggctaattcatcaatcgtattaccattatgaatcactacggacaacgtatttgctgattgtgaaacttcatgagcactcattagttgaccacccaaaaccttccgcgtttgttgatcataaaccaactcaatcatgactttcgccgtggtaggcataaagtccggccgataattgccttcataaaaagctgcttgggcatcgaagttagctgctttggccgccgttaaggtcagacctgcacaagccacggtctgatcaaaaatcaacatcccagtcgtcgcttgcgtaccaattgcacctaagcgtttatcaaagatattaattcctgccagtgcaccttgccgaattgcatgtgagactaatggcatataggcgtgttccttcgtaggattaaagttaacttccgtcacatcgccagccgcaaatatatccgggttggaggttcccatataacggtccgttacaatggccccctgcttcgttcggttgacctgtcccgccaataactctgattgtggaatcacccccggacaaataacagccatatcaaatatttcttcactatcagcggttgcaactcgtagtcgattatcagccgtatcactaaaagccgtcacttgtgcattggttctaacttggatgcctttcgtcgttaacaagtcttcgatcttctcagaaatttgtggatcaagatactcattaattaagtgggggccccgttgaaacaacgtcacagtgtgtccagacttcacgtacccctcagcaagttccacccccgaatagccaccaccaacgattgcaatatggtgtgcatgtttagctgcttcgtagagttgctgggcctgttcacatgttttgcaaagcatgaccttaggattctctacgcccggaatagccgggattgcagtgattgaacccgtcgccatgactaacttatcatagtgatccgtttgtaattcttttgtctgtaaattttgagccaaaattgtatgcttatcagcattcacattgatcacatcatactgcatccgcatctgcacaccttgttcactaaattcactaggattagcgtacaacgcttgatccaaattatggatggtaccccctaagtgtagataagtcccacaagacatatatgaaatatccgcgtgccgttcatagacggtaatttcagtgcccggataatatttcaagatttgtttcatggcggcaatccccgcatgtgtacagccaataatggcaactttcattgtttcgaccacagctttcattaaaagttaaaatttaacttggattaagttaaacatttatttaagttgacgtatacttagagtatacagcgattcggttgatattaaaacgattcaatgattttaaacttattataaaaggcgatggtacttatggaaccaatttaccgctattttgtacaacctcaacttaacttactcaacaatacagtttacggatacgaactactaatcaaacaactaaccccagacggctggcgtctgcctgaatcctttgccgcaattagttcacaagttacctctgatctgctcattgcaacaactaaaattcttggactaaaagttcgttattgtgcagtcaatatcagtcgcgaacaattgatggatacaacggttgcgaaggccattattcaaagtcaggttcagctctatcctgctaaattagtcgttgagctaactgaggaacgtagtcctaaggattatccagataccatgttaatcccacacttacgggggttcatcgaacatggtatgcaaatttcacttgatgatgttggtaccggaattaacgatttcaagagtatccaagaaattttgccattagcttctgaattaaaatttgcgttgcaaaacttccgcagtgatatcaaagatcctaagattcagcaaaagctccatttttggcgggccatcagtagtgaatacggattgcgtttaatcttagaggggattgaagacgccgaagatgatcgcttgagtagtcacttcgatattaatcttcgacaaggttattactatggcaaaccgcaattattacgcctacccggtgaccccgtcaactttgaatatccgacaatgaattaatttctaatatgaacaacaactaaataacgccttacgaaattaacttgaaatttcgtaaggcgttatttatcacttagcatggctagtcagctgggccgtacaacttctgactaaataaccaatttattctttaataaacgcttgaatggcatcttcaaatttcgctaacttatcattagcttcttctaacgtactacctagcgttccaatgtagaacttgatctttggttccgtaccagatggccgaatggctatccaagtgccatcatttaaatgatacttcaagacattcgcctttggcaaagcaattggtgccgtgtggccgtcagcaaagctttccgtttgactctggaagtcttcagtcccagtgacatcgtagccggcaaaggcagttggtgcttcgcttcggaacttagtcatcagagccgcaatcttatcgctgccgccaacgccatcaaattcttcggacgtggtttgttcgcggaagtaaccgtattccttaaacaagtcttgtaatccatcataaaggttcttaccttgttgcttataataagccgctacttcggctaaaagcactgtggtttgaatcgcatccttgtcatgaacaaatggtttgattaagtaaccgtaactttcttcaaaaccaaacatataggtatgttcgccagtggcttcaaaatgttcgatttgttcagcaatatacttgaaaccggtcaagacattgatcatcgtgacaccatatgaagccgctactttagtagcaaattcacttgaaacaattgacttaactgcggccgcattggtcggtaacgtcccggcatccttgtttgcttgcaagatgtagtgtaacaagacagcggcaatttgattacccgtcaacagaacatactcaccattaggttgacgaacagctgtccctaaccggtcagcatcaggatcaaccgcaatcaagacatccgcaccttcttttttacccaaatcaatggccatcttaaaggcttcaggaaattcaggattagggaatttaaccgtcgagaattcagggtcagccacagcttgttccttaacaacactgaagtttttaaacccggcattcttcaaagccttttcgccaagcatccggccagtcccatgtaatggtgtgaagactaacttcatgtccttaccgacttcatccactagtttttgattgatcgtcacttctttgaccttagctaagtagtcctgatcgacatcatccccaataatggtttccgtcttatcagctaataattgttgttcatcagcaacggcaatcgcaaagacatcgtcaactttacgaatatatgatgtgataagatcagattccttaggtggcatttgaccaccatcttcgccataaatcttgtagccattatattgcttcggattatggctcgccgtaatcatgatccctgcgtaagtatgcagatgccgaacggtaaatgaaagttctggggttggccgcaagctttcaaaaacgtatgacttgataccatgttggcccaatactcgcgcagattcatgcgcaaaatcttctgaatgatggcgggaatcaaaactgattgctaccccgcgttccttaacctcagcaggcaaggtatccatgaagcgtgctaacccttccgttgcttgacgaaccgtataaatattcatccggttgataccaggtccaagtaccccccgcatccccgcggttccgaattccattggttcataaaaggcgtcttctaaggcggcgtcatcgccagccatgcccgtcaattcttgttttaaactagtttcaagtgtcgcttggtttttccaggtattataagtatcctgccaactcacaaaaaccatctccaattccgatatttgttagtgcttacaaaaatagtatacaacattgacacactttacaaagtaaaatttactaagaaaatccattaattaatgcattttaaatgcgtagtgggcccgcatcagtgcgaatacccataaattctgaagtgctagttagttcagtcactatcaaaacttgctataataaatcttataaggaggccatcatgactttttattcatacaactacttagtccatcaaaataacaatcatactcttgtccaactcgcagccatcggcatcattatattaataatcgccatactcagctggttatggtaccgccataaaacagacctaaaataccgcgacttattcattatcatggttttattattattgctgctcgtcggcattcaatttaatgaatggcagacaatcaaaaatagtttcaaccaaaaatcacaagtgacacaaattatgcagcgtgtcgccaaagaaaaaggggttcgtaaaaccgcggtctggtctaatacaagttctgtcagcagtgggatgctcattaaagtccatgaccatatctataacgtgacgatcaatacggatggaaacagttataccctgactaaagccacaccgattcaatcaacaatcaattatgttaaggaggggcaataaatgttttcatactgggatgtgacgatcaaactggccctcgggctattgaccatcattctacaaatcaatctatctggtaaaagtaaccttgcgccaatcagcgccctcgaccaagttcaaaactacgttctcggtgcaatcgttgggggcatgatttatagtaccagcgttactgttttacaatacattttagtgcttctcatctggacactgctagtgctggtcctgcgattcctaacacatcacaatcgctacgtgaaacgtttgattgatggacagccacagctattgattaaaaatgggcaattactcgtcagcacggccctcaaaaatgggatgagtgctaacgatctgatgtttcgcttgcgtacggaaggtatcacggatattcgctacgtcaaacgggccgtacttgaacaaaacggccaactgacgattacccaagtgggcgacgacgccgtcaagtatccaataatcgtcgatggtcaggtcaacctcgatgcgcttgaaactagtaatcatgatgaagcctggttactgacccaattgcaggcccagcactatactgtcagtgatatttacctggcaacgtatactaacaagcaattgcttctatttccctatcaacactaattcgcgaacctttggtcatcgtcaaacaatgactaacgctatatttaccaataaaaaatgcgtggctgatctcaattaaatcagctacgcattttttaattttatttaactgttaactttgtcgcctaaagcagtgatataagtgtaaacgccttgaccggcagttccgccttcaccaaccgccgtcgcaacttggcgtaaatctttcttacgaacatcgccgactgcaaaaataccagagaccttggtttccatgtggtcattagtttcgatccagccgttttcgtcagtaatcccaagattactgaatggcttcgtaattgggttaataccaacatagataaagacaccatcgaccgcaatctcactgtcttcaccagtcttattattactaaccttaactcccgtgaccttcttatcatcaccgatgatttctgtcacgttgctattccaaacaaattccatctttggattagcaaaagcccgatcttgtaagatttgttgtgcccgcaattggtcacgacgatgaataaccgtcaccttatcagcaagctgtgtcaggtaagtgccttcctcaattgctgagtcaccgccaccaacgacaaccacatgtttgttacggaaaaacgccccatcacaaactgcgcagtatgagacaccgcggccaccatacgtatcctcgccagtaacacccagcttacgatattcagaaccagtcccaatgacaagggccttagtctcaaacgtatcgctatccgtcgtcacgattttaacatcgccgcgatcttcaacggattcgacgctaccatacgcgtattcagcaccaaactgggtcgctgattcatacatgtctttagccaaatccggccccaaaacagatttgaagcccggataattttcaattgcggcggtattattcatttgcccaccatagattccgcgatctaatagtagcactgatagattggctcgtgaagcatagagggcggctgtcatgccggcaggccccgcaccaataataatcacgtcgtaactctttgccatttctaaagaccccttccacttaaattcctatgacgcttaatatacccccaaaatttacatttgtcgactatcttgtttgtacacaactgaagtcaattatagcttttaaccatatattgactaaaaaccgagatttaaataaataaaattatgccagttcacttgaattcaacccatggtaagacttacttcttattgtaaatccttgtcattttgcttggcccaatcgccataggccgtaattcgtgggtgattgcggcctgcctggcgttcttgttcaatcgcttgttgggcgacgaggttcagataattgaatggttcatcaaaattaggtgagaataacatatccacaaatgctagatcatcgatggtgtttccattttgaatcgcgattgataacgcattagcagactgtgccacttcatgcgcacttaagaactgagcaccgagaattttacgattttccggattataaattaattcaatcgtcagtttcgccgtacttggcatgtaagctggtcgccagttgccctcataagtcacccgttcagctggaatatgattcaatttcgccattgccagtgttaaccccgtggttgccagcgtgtgatcgaagagttgcatggccgatgtcgcttgagtccccatatatcgttgctggttaccaaaaacattggcccccgctaacgcaccctgccgaaccgcattggttgctaatggcgtataagccgaacgcccagttgggttgaagttaacgacacaagaatcaccagcagcgtaaatatctgggtcagaggtctgaacgtaatcattgatgataatggcaccgtgcttatccatctcaacttgaccgcgtaacagttctgtattgggaacaaacccagttccgacaattgctagatcagcattaaaatcgccttgattggtttcaatgacaagttcaccatcatcattaccagtaaaggcagttacttggtgattcaatagcacgttcacgccatgatcttttaatagctgaactgcttggtctgaaatttctttactaatgtaattattcaaaatttgatcatgcgattggaataacgttacttcatgatgtgtatttgcataactttcagataattcggttccaatataacccgccccaatgattgcgatccgctgattgtcttgggctgtttggtaaatttcctgtgcttggctgtaggtcttgcataataggaccttagactcatcgattccaaaaatcggcgggaccgcaacatttgaaccagtcgtcataatcaatttatcataagtatcgccaaacacttttccagtagtcatgtcaaccacttgtaaggtcttcgactgggcgtcaatttttaacacgttatgtttggttctgaccattgcccccaacttggctaacgtttctggtgacgaatagaacatatcttccaagtgattgacctttcccccgagataaaggtagatcccacatgataagaatgaaatattgtcatcacgctcataaatcgtgaccgtagcctccggatgatccttcagaatttgtgcagccgcagcggtccccgcatgcgtacatccaacaattacaatcttcatttcattttgctcccaattataattttatttatttaaccataggtatattataaccgctttactgcgcaaatacataactctagtcaatataaatacaggtcatgatgaaacataactacttttaaaaaccaatcagcgatacgctggcaagcagttattctcataatatcgtccataccagctttgccaggtaaccactaattgactttttactcattttcagaaaattaccttgttcaccaagcagtttagcacaatcatcattagcccaattgataatcgataccatgcaaaaaaagatggtgtcaaacagtttcacttattcattttttggtatagtatgtattaggaagcatcaaatcgtgttaattcaagtctaaggagttcccttatgtaccgctattttattcagccccagttagataaatttaataattcactgattggctacgagatgctgattcgctatcgtgagactgatcaggaccggtggaccttaccagaaagcttcgataatattccgatcgatgtacaagtcagcttactaaaggctacggctagtgagcttgcattaaaaatcgggtcagtatcaattaactttaatcgcaagcaatttttaaatgatgatattgctgccgcagtcattgatgctcagaaaaagctattcccggttcatgttatcgtcgaagtcacagaagaacccggtgaagatacgtttacactggcggcgatgcaacaacaaattgataagtacaaggctaacggcctacaatttagcattgatgacgttggcacgggaatcaacgtttacgaccacattaaaccgctactcgaatcggccgaagaaatcaaattcgccatgcaaaactttcgggccgaagatcgtgaaaacgagattcccattcaattaaaattctggcgcgacattgcggtacaacatgatatccgtttaattctagagggtgttgaaaacgatgccgaagatcaaatggcgaatgacttaaatatttcactacgccaaggttattattatggcaagccccatttattcaaattaaaagccgaccactaggtgccagcttaattagtgaatcgcaattattcagcagttaactaaaaacaaccgtgaaatcttaatagatttcacggttgttttaattaatcaagtattatttagttggtttcttcgttgttttaggagcggcgctatcttctttagataacttagcaccaagatccttgatgtaagtccgcaagtcagccttaacatccggatgagttaacccgtattcgatcgtcgtcttcaagtagccaaacttgtagccaacatcgtgccgagtccccttaaattcatgggcaaagacccgctgagtcttgttcaacgtatcaatggcatccgtcaattgaatttcgtcacccttaccaggtttttggttttcaagaacatcaaaaatttctggtgttaataagtaacgaccaatgatagcaagatcactaggcgcgtcttcaggtgatggcttttcaacaaagttattaacgttgtataggcccggttccttttcactttcaggattgataaccccatacttagaaacttcctcatgaggaaccttcataacagctaacgttgacgcatgtgtcttgtcatagctattcattaactgtttggttaacggtactttgtcttccattaaatcatcaccaagcatgacgacgaaaggttcgtcaccaacgaaagctttagccgttaaaacggcatcgcccaaaccacgtgggtgtgattgccggataaagtacaagttaatgtctgtggtttcttgaaccagcttgagcatttcttccttgtgcttagcccgtaagttatcctctaattctgggttagaatcatagtaatcttcaatactacgcttgctcttacccgtgacgataacaatgtcttcgatccccgatttacgagcttcgtcaacaatgaactgaatcgttggtttatcaacgattggtaacatttctttaggcatcgccttagtagcaggcaaaaaccgtgttcctaatccggccgctgggataacggcttttctaacttttgacatgtgataaatcctcctaaaaatagtgaaattagtttggaaattcctactgaatctcaggtttcccctcgcgccgcatcaattgtggaatgacttccttaatgtcggcactcttatataatacatcataaatcgcttcagtgatgggcatttcgatattttgttgctgtgcaagctcgtaagcggctttagttgacgggataccttcaataaccatgcccatggtatcaatcaccgtcttgaggtcctgaccagcacctaactcattaccagcgcgccagttacgcgaatggacactagttgccgtaacaattaaatcgccaacaccggataaaccgataaatgtcaacggctctgcgcccaacgccactccgagccgactgatttcagctaaaccacgagtcattaaggctgccttggcgtcatcaccatagcccaggccgtgtagcgcaccagcacccagggcaatgatatttttgagcgccgcacctagttcaacaccaaccacgtcggtattcgtgtaaatgcggaaatagtcattcatgaagagttgctgtactaattcggctgcagattcatcgacgctagccgccgtaatcaacgtaatatcgtggcgggccacttcttcagcatgactagggcccgataagacaacgatcgcttgtcgtaattcggcgggaatttcttctgccaaaacttgcgacagccgcttgtgtgtctcttgttcgagtcccttgctagcatgcacaataatcggccgctgatgggtcttggcaagcacggcagtcacttgttgggccacttcgcgaatcgctttggttggtacgacaaacaagattacatccgcaccatcaatcgcctgtgttagattagaataagcagtcaacgtttctgaatatttaaaatcaggaacgtatcgctcattcgtgtgttgctcatttaattctgtgacttgggccggtgagtacgaccagagccgcactgagtggccattttcatccaacagatttgccaaaatgctaccccatgagccagcacctaaaacggcaatttttttcatcattcaaataaccctctaatctacttattttctgcgacaaccttttgaccagaaccagctaaataccaacgattattcggattgtgacgccggcgccagatcattaagccaatgctaccaaagaacagtaccactgacaacgcttgtgagacccgaataacgttaaataacatgagcgagtcagtccgcatcccttctgtgaagaagcgaccaaaggcgtaccaagcaacataagtcaagaagacatcaccctgcttataccaatgtgtgcgatgacgcgtgagcatcagtaaggcaaatcctaatagatcccataccgactcatacaagaatgttggttgccgatacgcgccacggatatacatctggttaatcagccaatcaggtaagtgcaagccttgtaagaaactcagactagtcactcgaccaaaagcctcctgattcataaagttaccccagcgaccaataccttggcccatgatcaccgttggtgcggcaatatcaagcattagccaagttgggataaagcgtgaccgacagaataaaatgaccacaattccggcgccaatcaagccaccatagatggcaattccaccatcccagatacggatgatttcaccgggattctgacgataatatgaccactggaaaatcacatagtaagtccgcgccgcaattaaagtaaacggaagtgcccataaaatcatatcgtaaatgtcatcgggccgaacaccccgtcgctgaccttcacgtactgctagtgcaaccgcaatgacgacggcactagcaataatgacgccgtaccaatggacctgaattggtcctaaccgcagtgcaattgggttaagtgcccctaaaacggtattcacgctactgccatctccttattacttgtgagaatcatgcacggaattcgttttgatcaacttgttcaagttatcgtcaaagaccttggtcgcatcgtagcccatgctctcggcccgaaagttcatggccgctgcttcgataatgattgctaggttacgtccagtcttaactggaatcgagatttcaggaacttcaacatcaaagaatttccggttctgttctccatttcctagtctatcaaattgcttatcaggcgtccaattctcaaggtgcacgataaggtcaatgtcggtatcttgacgaacagccccagcgccaaaaagattcataacatcaataattccgatacctcgaatctccaataagtgattcaagattgcgggtgcttcaccgacaagcgtttgttcatcctgttgatagacatcgacccggtcatcagcaatcaaacgatgcccccgtttgactaattccagggccgtttcactcttcccaacaccggaatcaccagtaatcagcacacctaatccatagatgtcaactaataccccgtggacagattgtcgttcagctaatttaccttccaagtaattcgtcatattacttagaatccgtgatgatgtcattttcgttcctaaaatcggcacgccattttcctcaccggcttgcacgagttcttctggaacgggtaaccccgttgaaatgacgaacgcgggtgtggttaactgacacatcttacgaaaaatcatcagtcgttcatcatgactcatatttttcgaataagcggtttcagttttacctagcaattgcactcgttcacgaggatagtagttgaagtaaccggtcaacgccagccccggacgtgaaatgtcgctcgttgtaatatctttcttttctaataagtcagcgccatgatacacatccaggcgcgtatttttcaccaaatcggcaacggttacacttcctgccaaaagaatccctcctaattgttccactaataaaaaagtgtggcccgcgttgtccagtcgcgccattacgctaccctttcaagcggccacacttttatgactgaaaacggattatttctatcttctaatcttagcactttaaagcgctttattcaccatcaacgccgtctttcgcgaaaaagttggaaacaatcacgttagcaattgacatgagaatcgaaacaaccatcgccatgccaaaactcgaaaagccgaaattggccttacccacaacgtaggatgtcatctgaagcataaaaccattgatgacaatactgaatagcccgagtgtcaataacgtaatcggtaacgataataacagcaaaaacggcttaatagcggcgtttaaaattgcaagcacaaaactggcaattaaagccatccacacacttgcaacgtgaaaactgctctgaaaaaagccagcaatcgcaataaataagattgtattgattaaaattcgtttccaaaagcccactgtataatcactccattaatcttagtgacgcggatcatcctcttcatgaacgttatgaatctctttgcgcccatgcgcttgcggtttagcttgagtaccggtactttgccgcatctgttcgaagaaacccgtattgtctggtttacttgggataattgtcattaatactaagtataccaaaacaccaaagccatgggtaaccaaggttaaaataacgtagagtactcgtagaatcgttgcattccagttcaaatattcagcaatgcccccgaggacgccggcgaaaacgcgattattagatttagttaacttttgttttgtatttgatttcatcgttagacgctccttatcagtttatctaaccatatcttactaattgtaaaagccggttgcaaactagacgaccggctttaagcaattatttatgattagttacactaaattagaactttctggattcaattcgataatctcaccagtattcaaatacacgatccactcaccaatattagttactaacgccccgatgcgcattaggtaagttgcaacattcaggtaatccgtggaaccgatgaccgtctcaggatggcgctccatcttggagatccccttctcattaatacgatcatacatctccccgacttttgcgtctttagctgcgacccggcgtgcttcctgatcatcacttttgacgtaagctgccaacatctcttcgaccatctttcgcacgcgattccccatttctgataacgctgcttcaatttcagggacgcgcacatttcctttgacccgaatcgtagcgtgagcaatattacgtgcataatcggccatccgttccaattcagagacggctttcaaaatggtgacaatttctcgcaaatcagaagtgacgggttggtataacgcaatcatctcaaatgatttctgttctagttcaacttcccgttggttgattttagcatcattatcaatgatttcttgtgcgaggtcgcggtcatggtcgataaacgccttgactgccttttcaatcgtctcgctaaccatcattcccatttcagtgaagtttgcatcaatatcgtttagttcatcatcaaaaagtcgtcgcatgtttttttcctcctaaccaaatcgtcctgaaatatagtcattggtttcctgtttaactggattcatgaaaatctgtttcgtgtcgttgacctcaattaattcaccattcaggaaaaacgccgttcggtcagaaattcgtgacgcctgttgcatgttatgcgtaacagttatgatagtgtaatcctggcgcaaattcaatagggtttcttcaatcatccgactcgatatcggatcaagtgcactagtggcctcgtctaaaaggataatatcaggttcgacggctaggacgcgtgcgatacaaacccgttgttgttgcccaccagacaatgatagcgcattggcatgcaaccggtccttaacttcatcccaaattgcagcctgcttcagacttttttctaccgccgcgtctaagcgttctttatcatggactcctgccaaccgtaacccgtaaatgacattctcataaattgagaatggaaagggattcggctgttgaaacaccatgccgatttctttacgcaattgaaccgtatcggtcgtgggcgcataaatattgtgaccattgaagttcacctcacccgtgatcgttacattaggaatcagatcgttcatccggttcaagcaacgtaaaaaggtggatttaccacagccagagggcccaatcaaagccgtgattcctttatcatcaaaatcaatgttaattcctttgagggcctcttttttaccataaaataatgataagttctcggtcgttaaaattgtactcatgaacggtcctcctatccaaagtttccggaaatatagtcattcgtcagatcaacctgaggattggtaaaaatctcaccggtctctgagtattctaggactttgccgaggttaaagaacgcggtatagtcgctaattcgcgatgcttgttgcatattatgcgtcacaataataatggtataattctgctttagttctaacaaagtatcttcaatttgacttgtcgatactggatccaaagcactcgctggttcatcgagcagtaaaatgtctggcttgattgcaattgcccgagcaatacagagtcgttgttgctgcccgccagacagagctaacgcacttttatttaagtcatctttaacttggtcccacatcgccgcttgccgtaaagaccgttcaacaatttcatccaagtcttgtttcttgttcattccgcgctggcggagtgcaaaagcaatattctcatagattgatttggcaaacggattaggccgttgaaacaccatgccaatgtgccggcgcatctcatagacatcaatatcattactgttaatatctaagccgcgatacataattttgcccttaaccgttgcaatacggtcattcattcggtttagcgaacgcaagtaggttgactttccggaaccggatgggccaatcaacgcactaatcttataacgttcaaactgtaaatcgccctctgaaatagcctcggatttaccataaaagacgtgtaaatcctcagttgaaagcgcgatttcatgatctttaggatcaaacgccatgatgttacgttgtgtcgtcgtcattgtgttatctgccatcaaaacggcctcctttattcagcggttaagtgtttgtacaagcgtttgccaagccaacgagctaagaagttaaagagcaataccgcaataattaatacggctgaagcccccgccgaaacggctttcgcgtccggcataattccttctgagttgatcttccaaatatgaacggccaacgtttcggctggacgtagtggactgagtggactactgatatcaaatggattccagttaccaaagtccaaggctggtgcactttgacccgcagtgtagattaaagctgcggcttcaccaaagatccgcccggcactcaagacgacccccgttaaaatgcttggtaaggcagcgggaaccacgatcttcgtcaccgtctcccaacgtgatagccctaacgcgtagccggcctcccgttgattatctgagatattggcgagtgcttcctcaatactccgggttaaaatcggtaagttaaacacggtcagcgcaaacgccccggaaagaatcgagaagcctaacttgaactgcactacaaagaacaagtatccgaacagccccacgactacggatggcaatgaactcagaatttcaatggtcgtccgaatcaggccagtcaccgtattttgcggcgcatattcatttagatagatccccgcacccagtgaaatcggtaatgaaatcaataacgctaaaaatagtaagtagaaggagttaaacaactgaatgccaatcccaccacccgcttcaaaagccagggccggcgacgttaaaaaatgccacgaaattttgggcaccccttggatcagaatgtatcccaatagggcaactaagatgatgaccacaaaggctgcgacgccgtatagcacgccagtggcaattttatcgatgcgtttagcgttcatggtttaatttcccctttcgaccaatgtagcgaatgactaagttaaagactaaggacatcaataacaggatcatggctaatgaccacaatgcattattttgtaatgaacccatgacagtgttcccgattcccatcgtcaagatacttgtcaaagttgcggctggtgaaactaggttatgcggcaacaacgtcgcgttcccaatcaccatttggaccgccagagcttccccaaaggcgcgggccatcccaaatacgacggcagtcagcatgccaggaatggctccccgcaggacgactttataaattgtttgccagcgcgtcgcccctagagctagcgaggcttctcggtaataacggggtaccgaattcagcgcatccgccgtcattgacgtcacggtcggtaagatcatgacaaatagcacaaaggtcccagaaagaatcccgtagccactccccccaaacgtattacgaacaaacggtacgacaacttgtagcccgataaatccatacactacggatggaataccaactaatagttccgtaactggccggagaatcttcgccccccgccgtggtgaaatttcggtcataaagaccgccgtcccgatagcaaacggtgtggcaattaaggccgaaagaatcgtaatcaaaaacgacccaacaatcatcggtagtgcccccacagctggttgcccattcgttccgactgttccggggttccactgcgtcccactcagaaattgccatagattaatgtgattttgaaaaaaggttgctaacccccgtgatgcaacaaagtagaaaatcaaaaagacaatcccgacaattagcgctagacaaactagactaatggccttaccacgccgttcaattttactagcaactgatttttttaataagctttctcgaattttatccatgcgctctccctcatttcataactgaaactttaccggccgcattccgctgtacttgcatgtcatggaccgaaatataacctaactgcttgactaacttctgctgaacagcggttgataaaatgtaatcaataaattttttggttaactgattggggtgcttccccgtatataaatgttcgtaggaccagatgtaccagcgattattccgcacatttttttcggttggccgaataccatcaacattgacggtctggactgagttgtctaagtaagaaaaagccacataactaattgcgccaggtgtactagcaacaattgaccgagctaatcctgacgaatcttgttcttgggaatcaacactctgattaccctttaaggcgtatcgctcaaatgtcttccgggttccggagccttgagcacggttaattaacgtaatcggtaaattacgtccaccaacttcacgccaattcgtgaccttgccagtaaaaatctgaatgagttgctgctgcgtcaaattggtaatgcccgcctttttattaacgatgggggcaataccgacgacggctacccggtgatcaattaacttgctcgctgtaatgccagactgttcttcggcaaaaatatcagaattaccgattgccacggcccccgcctgaatttgactgagtcccgttccagagccaccaccctgcacattgataaacacaccggtatggttgctgctgtattgttcaccggctgcttcaaccagtggctgtaaggccgttgatccaaccgcggtaattgattcactggcactagttcgatcacgatgtgtgtaccctaatccaactagtccaatgatcgcgattaacacgattaattggatgacccgactttttctcataactatatacctcctacccattgctcatattcaataatacaaagtttgtgtaaatgctttatatgagttttgtaaagattgtgtaaacgtcgatatatttttaattattaccggcttttagcccccaatatgaaagaaaaattaaaaaagtgcacaaaaaaacgattttcaaggtttacatttaccttaaaaatcgttatcaattcgtctggcttaattacgacacattcaattctcaactaatgacatcttttgactcagcaatacaactcataccgtcaccacgtcatcatttgatagaccaccagttacaatcagaactgtccgtatgcttaacgccttactactgctcggaagcactcgcagctagtggcaatgtaactgtcatagttgtcccaacgccccgttgactgacaacgtcgattgttccgtgcattgcgttgaccaattcttgaacaatcgctaatccgagtccagtcccactcacaagttgctgtgaacgtgacggactcgcccgatagaagcgttcaaaaatacgctgttgatcatcggcactgataccaatgcccgtatctttaactatcagcgaccacgtttgatgactgaccatggtggcaatcgtcacgctaccatgaggtcgattatacttgattgcattcgttaacagatttttgatgatctgactcaacttctgtgaatcgctcgttatcattagatcagcatcgacttggttattgatcgttaagtgctgacgttcgattgcctgctgaactacagccagttcctgttcgatcaatggtcgaacagcaagcggagctaaggttaacatcgtcgtattctgagcacgaattcgcgatagcgacagaacatcctgaatgagatcaatcaaccgttgactttcatccgcaataatatgcaagaattggtcaagcgtgtccggatcatccttggcaccacttaacaacgtttcagtgaaaccggaaatggctgtaatcggcgtcttcaactcgtggctagcgttgctgacaaaatcatcctgcatttgttcaatcatatagacttcagtgatatcatacaacatcaggacaatttgaaattgtgaacgattgccttggatataaacggttgaagcctcgacaacctgcgtgttaggcgctggggtcagcgtaatcgttgcccgttgatttttgccactagtaatcgtatcttcaatcaatttagtcaacgcgtacagctgaatatccttggtataaatgtgggccaccgtattaaccgagacttgcaatagttcactcatcgccggattagacagttgaacctgtcgccggtggtcaatgaccatcactcccacaggcaagtaccgcataatcatcattaactctttttcttgcagttccgcacggcgcgtctgacttttttgataactctctaactggttgaccgcttgtgctaggctgtataaggggtccgattgtggcaataagatatgtggtggaaattgctggctactcatctgacgaagcttagcttccatacggtcgatcgtgcgctgccgttcactttgttgccgccaagcgatcaagccctcgattactgccaaaaccagccaagcaccaactaaacaaccgactaggcgccaggaccacttaattggcgaaaagtgctgcaacacgaccaacacgatcagaaccagtaacacattttccatgagcaataaccgtgtcgtctgttgccagcgattatgcatggccgtcacccacaaattcgtagccaaaaccccggaccgtcctgatcaaccgtggctgcttgggatctgcttcaatcttttcacgtaaatgtgagatgtgaatatcaacgatccgcgtctcactagcatagtcgtagccccagacgtgatttaaaatcgcatcacgactgagaacccgaccttctcgttcaacaaaatacacaagtaattcaaattcctttggtgtcaagctgatatttttcccgttgcgcgcgacccggtatttgttttgatcaatctgtaaatcaccaacaagcattaccgcacgattagcaggcggcatgggtgccggtggtgtcacgggctcgtccggcgttgtccgccgaataactgctttgatccgagcgagcacttcgcggggtgaaaacggcttggttatataatcgtccgcacctaattccaagccgaacactttatcaaactcatcatttttagccgtcacaataataataggcgtctgaaccttttcttgtcgtaacttttttgttacttccattccatcgagtttcggcaacatcaaatctaacaaaatacatgtaaatgattgggccaggcctaatgacaacgcgtccgcaccatccgtcgccgtcacaacttcgtaccccgcctgcttcaagttatatgataataacgtgacgatagctggttcgtcgtctaccactaaaatcttatccatggtcattaatcctcctgatcagtgaataacacaattcctaactcgtgtggggcgccattatagatcgccgtttcggtaataattaattcctgttgccgattgcgcactttgaggtgaacatacgtcggacttttcagtagggccgcgtaaaattcagcttccgtattaactggttgccggttacattccaagataatatctcctaaatcgagatttaatttatccgcgggcgtgtgggggcgtaacccaatcacccgcacaccttgttcagtatcagaatatcgaaactgttggtgtcgatcatgataacggtgctgtgctaaaattccccaagttagcacaacgattaatcccatcaatgctagcaaccactgcgggctgagcactgcaaaacgggcaatgattgcaaccaaaacactcgcgagtgttacccaaccatagcgggccgctaactgccgccatgcaatttgtggcagctgcttataaacgcgaacactcgtcccaactaataaaggcaacaataaaatgctgaaggagcgctcgccaaccataaacacaggccaccaactgatagttgcgtgtaaccaatcaccggggaccagtaccccaactggtaagaccaacaattgttgccactggtaacgaacaagtcgctttccacgttggtcgggctgtagttgcggtgaacggccctcataatcatagtgtcgtaacaagaccgccgtagccgccagcacgatggctaataacaatagtccgttcaccaccaaattgccactcatactggtcatggcaacaccgtgccgttgtaaagcgccccccaccgtcgttaattccgggctcataatccaataaactaaccagctgaggccaaaagcggtcactggtaccagtgcaccaggaataatgatcaagctaatggccgccactacttcgtatataaccacccagatgggggccaccactagtcccaatgccaagctaataattgtcattagaactcctagtaaacagccatccactaaaaagtggtggacttcaactaattgtgggttgatagcactctgaaaatgctgccgttcactcttcacccgccgtttagcggttaaataactacgcagcaatcctaaccaaactagcggttgtaaaagaaacaattcaaaaatctttaatacctgcatgtgcgtgacccctaacgttaaactctgaagttagtatagcatttttgcccaaggagaccaacgccgtttcaattccgtcagtcctgctattaccgctttaatatctctatattataagactagtagccaaaaaaatactaagacgacctgcgcaatgataggtcaccttagtatttgtgcaatctattgcggattacgttgggctaatttccattgtaagtaagcatccataaacggatcaagatcaccatccatgacagcctgcccatcatgtgattcataattagtccggtgatccttgaccatcgtatacggatgaaaaacgtaggagcgaatttgtgagccccacccaatgtccatttgctcaccttggatggccgcccgttccttagccttcttctcttcttcacgttcgtacaacttcgctcgtaacatgttcaatgctgtttgtcggttctgtaattgtgaccgttgcgcttgactggcaacgacaattcccgttggcacgtgggtaatccgaaccgctgaagaagtcttattgacatgttgtccaccggccccactggctcgataaacgtcaatcttcaaatcttcaggtcgaatatcaacatccacggtatcatctaactcaggcatcacatcaacactcgcaaaagatgtgtggcgccgaccagccgcatcgaacggcgaaatccgaacaagacgatgaacccctttttctgaccgcaaataaccgtaagcattgtggccgctaattaataaagtcacactcttaatgcctgcctcatcaccagcttggtagtcaacagtctcgactttgaaattgtgactcgcagcccagcgcgtgtacattcttagtagcatcgcaccccaatcttgggattcggtcccaccagctccaggatggatttctaaaatagcgttattgcggtcgtacggaccgtccaaaagtaagttgagccggtactgttgtaaatcatgttcagcgtgctgaaagtccgtttcaaactcagcctgcatctcagcatcgggttcctcactcagtaactcataagcgactgccaagtcaccgacttcatcagctaattgcttaaacgtatcatactttcctttcaacacgttattctcatcgatgactttctgggcggcagcctggtcgtcccaaaaaccgggttcggccattcgagcttcattttcttgaatgctttcgttcaaagcatctaagtcaaagcgaccccctaaagtcgtcgacagcactttgcatttcttcaatcaggtgtttatattcacttaattccacaaaggacccttctttcaacttatttattaattatttaatatctggtttaactgtaaaacgagcctaagaccttagtcttagactcgctagcactaacgttaaattttaacgttgaatattttggcgaatttcagacttcatgaagagtcgcgtcgtatcataatcaatatccgcaaccatttcttcaaacatctggtaaccgtctcgttgatattcaactaacggattcaattgaccatagccccgtaaaccgatcgattgccgtaattgatccatcgcatcaatgtgatccgtccaatgagaatcgaccactcgcagaataacgactttttcaaattctagcatctgacccgcatcgtaaagctgtttagccttgtccgcataaatcttatcgacccggtccatcaagtaagcttcaacctctgctggcgacttacctttcaagtcagccacactaattgaatcttccttcaccatagcagcttgggcaaagtcaacaactgcatctaaatcccagtccttggcatcgccttgcatgtgtaactgaacggtccgttcaacggtccgcttgatcattggcatgataacgggcttcaaagatttttcttccataatgacttgttgccgctcgccgtaaatcacttcacgttgagcccgcataacatcatcatattgtaaaacgttcttccgggagtcatagttgttcccttcaacccgtttttgagcggactcaacctgtcgagtaatcatccgtgattgaataaccgcatcatcatcttcaacattcatccgttgcaggaagttcttgattcgttctgaaccgaaccgtagcatcaaatcgtcttcaagtgagaggtagaattgtgacataccaggatcaccttgtcgaccagcacggccccgcaattggttatcaatccggcgggactcatgacgttcagtcccaataacggcgagccccccgacttctttgacaccaggtcccaacttgatatcggtcccccgaccagccatgttggtggcaatggtaaccgcaccacgttgaccggcgtttgcaacaatgtcagcttccttcgcatggttcttggcgttcaagaccacgtgcggaatgttttcctcatccaagcgatgcgacaagtattctgacgtttccacggcaacggtcccaattaacattggttggcccttttcatggagttgtttgatttctttaacgaccgcgttgaatttgctttgtaacgttgggtaaagcaaatctgaacggtcatcacgaatcatcgggcggtttgttggaatcgtaataacttccatgttatagatttcgcggaattcttcttgttccgtcttggccgtcccagtcatcccagataactttttgtacatccggaataagttttggtacgtgatattcgccatcgtcttggtttcttcttgaatctcaacgtgttccttagcttcaattgcttggtgtaacccgtctgagaagcgccgaccatccatgatccgccccgtaaaggaatcaacgatcaacgcctgaccgtctgaaatcacgtagtctttatctttcaacatgatgtagttcgcacgcaaagcttcatccaagtaatggtttaacgccgtattatcagtatcgtaaaggttttccaagccaaagtatttttcagccttccgaatcccttcgtctaataatgcgaccgtcttagattccaagtcaaccttgtaatcttcatccttcgtcaacgtcttagcaaaacggtcagcccgcttatacattcccgttgtaccttctgattgaccagaaatgatcaacggtgtccgggcttcatcaattaagattgagtcaacttcatcaatgatggcaaaattaagtggtcgttgcaccatgtcttcacggtagaccaccatgttatcacgtaagtaatcgaacccaatttcaccgttcgtcgaataagtaatatcggcgttataagcggcacgtttttcttcaggcgacttttcagccccgttgattccgacgctcatccctaaccagttatacagttcacccatttcagtcgcatcacgcgctgataagtattcattaactgttacaacgtgaacacccttaccagagatggcattcaaataaactggcatagtggccgttaaggtcttcccttcaccagtcttcatttcagcaatgtcaccttgatgcaaaacaattccaccgaggatttgaacgtggaatgggtataaaccaagtacccgcttcgcaccttcacgcgccgttgcaaatgcttcgggcagcaaatcgtcgagcgattcgccctccttgtaccgttcacgaaattctggggtcttcgcttgcaagtcagcatcacttaacttgccgtattcgtcggcataagcttcaactttattagcaatcttatccagacgccgaatagtccgcttgtcgctttcaacccagcgttttaaaatgttggccatttacgtatcctctccaaataattaatcttaattttaatttcaattgtccatttcaaaataaaataccatctgtcattttaccattatttactagcaatgaaaaccacaggcccctatgtaaccgataccgtcgaccgttttatttacatccttaactaaatattagtctttaaccacagcccaacaatcactgacccgtgttctttaattctatcaatatttgcttaactgtcttgagtcgctggcaaaaacgtgccgtgagtcgaacttcagcttactaacgcgggctaagtcactctcatgatcacaatatgttatacgggcgttccgggataaaaataaagaactggtcaactgaccagtcctcataagttgcgcttttaaaattagtgattgtcgtcggtttcaatcaaaccgtaacgaccatcgttacgccgatagacgatgttaattgcgtccgtttccgcgtcttcgtagataaagaagtcatggccgagcatatccatttgcagaatcgcttcttcattatccattggctttaaagccactcgcttcgtacgtacaacgtctaacttatcgtcctgatcattgtcggcagcggcaactgtttcatcagtcgctgcaaaatcaatcgctttataacccttttcacgggatttgcggttaaccttagttttatacttgcggatttggcgttccaacttgtcagtaaccaaatcaacactagcatacatatcaggagaagtttcttctgcccggagaactaaatagggaagtggaatggtgacttcgactttagccgtcttgtctgggtgaacttttaagttgacatgggcaattgagtcaacattattgtcaaagtacttctgtaacttacccacccgtttttgaacgtagtcccgaattgcttgggtcacttcgatattttcaccgcgaatattaaaatttagcatagatcttctctcccttcacacacattgctgtgtacccaaagtaattaaaggaccactctttaattactttgcttaaattcattataatagaaagcgctataataaacaatccaaataccactttccctcgaaattaacgtgctagcgttagccccgtcacgctcttggcaccgttttccaaaagtagcgttgccgcgtggcgcatcgttcggccggtagtatagatgtcatctactaataatacccgccggccggccaaaatcgtattaggagccatcttgaatggttgtggtgttctcaaccgcgcttgccggtctttcttagattgtggcactgacttcgctgttgcctgggtcattaacccgggcgcgaggggtgcggctaaccagccggcaacttgattaaagccccgtgtttgcaatgttgtgggcgtgacaggtaccactaagcatatctcagcacaccgttgtaccactgcttgttgcatgatcttcgcaaaaacttggcgtaattgataatcaccctgaaatttatagcgttgaaaataatcatgcatcgcatcattatattcgaacaacgcctcgttatgaaagggaccgatttcaggccaccgctgacaatctgtacacggttgtggtcgtttttgagcacgtccacatttggaacatgccgttgcccgatcgatgcgtacaaattgccgccaacaaaccgagcagacgaccggccgcataaccggctgccaactaagaatccagggcaacgtaaacttagtcgtgataatgttgtgacacagtaggcatgctagcacgtaattgtcgcccctttcgattgatcacccgaatctggcgctgagcgcgtttgatattgcggctatgactgtgacaaataaaccagacgaggccagtcggacgctcactgctgcgtccgacccgtcctgcaatctggacgagggcagccgtagaaaacacttcgtcgtccgcaccaagcacaatcacatcgattcccggaaacgtcacccctcgttccaatatcgtcgtcgtaactaagtattgaaactgctggttccgcatttgttgaaccttagtcagtcgctcaggatcggctgagtacaccgtctctccggtcatatggggaaaatagtgttggagtaccgcaaacactggcgctaattgttggatgcgcgggacaaatagtaaaaagcgctggtgctgttgttgatactgttggagttgccggataaggtctcgtggtaattttccttgttgcaagagccgagcccaatttggctgtagcttaaccttaattgccggtaataaatgttggtgaaaccgcaatggtaaataactgattgcaagctcaccacgatgaacttgggacaacaaactttggctgggcgtcgcggtcaaataaagaatggccccctccaccttagctgcctgattcactgcaaacgccaaacggggattggcagcaaacggaaacgcgtcaacttcatcaatgatcaatacgtcaaacgcctgacgaaaacgtagcaattgatgcgtcgtacaaatcgtcagctgcgtatactgatagggagcgggattgcggccatgtagcacagcaatttgaacatcagcaaaggccgcctggagccggggtgctaactctaagcaaacatcgactcgtggtgaagcaatggcgacccgccactgatgcgctaacgcccacgcaatacctggaaacagcatttcagtttttccagctcccgtcaccgcccataataattgccgtttatgcgccatgaagttagctttgattgattgcgcgcagtccgcttgctggggcgttagggttccttgccacgtgcaaaccgggaccgttgcaaaagcattcggttctggcatatgatagagtttaactagtgtactcactcgacctaaatttaaacattgataacagtaatattgctgattgggtaattgggctcgcagtcggtccaagtgactgccgcaacgctgacagataatttgatgttcatcaacctgcatggctggcagtatctgcgtgccagcaggtactgcggcagcctcatttgcagataatgcgagctgacgaccgtataagacttgtgcttccattgtgcgcacctccttagttatcaagtacgccatttaacgatttattcacgaaaggaaccgattaatttgactaaaccctactacaccatcacccaagacacggtatttgaacaaaccatcaaaaagtctcgcttcatcgctcatctataccgcatcagtgacgaagtggatgctcaagctaagattgccgctgttcgagcagataatcctaaggccaaccacaactgtttcgcctacatgcttggtgatgatgatcatattcagcggatgagtgatgacggtgaaccagtcggaactgcgggctcaccaatcttagaagtgctcaagaccaacgagctacacgacgtgcttgcggtcgtgacccgttattttggtggtatcaagcttggcgccggtggactgatccgagcttataatggcacccccgcgcaagcaattgaagtcagtggtaaggttcagcgaatcttacaagcccgcatcgccatcacgctcgactatcgtaacgtcgatgctttaacctactatttacaacaaaataagctaacgaccctgaataccgactacggtgttcaagtcacacaaatcatcgcagtcactcaatccgaaattgcaacgattcagcagaacatcactaacctcttgagcggtcaagttaccttttcggagcaaggtgaacaatttacagaaattccggtcactacgcctggcaactagattgctggttatatataattgggagcctcacaaactttgattggcagtcaaaatcgaaacagccaactcgtcttaacaataacacccagcacttgagccgatgatttgttttttcattgttaaagtccgcgttgcactaattgcggcccataaaaaaagtcgagctatcgctcgactttttgtctgttatttattttaaattagtgattgcaccagattggccacgatcaaccttcatcgaagtcaatggaatatatcctaatttctcaactaaactaccttgaacggctttagaagtcatgtaagttaagaagttcttcaactccccagttggttgccccttagtatacatgtgttcataagcccaaatcttccacttgttcgtcgctacgttagcttcggttggtttgacgttatcaatagaaagcgcctgaacgtcactcttaacgtatgagaatgctaagtaactgatggcaccaggcgtggtgctaacaattttttgaacggtcccattcgaatcttgttcttggctagttgcgaccttcgcgttgtctaatccccatttttcaaacgtcgcccgggtcccactaccttgagcacggttaacgacggtaatcttttcgtccttaccgccaacatctttccagttagtgatcttgccttggaaaatcttgataagttgttcttttgaaatattagtgacaccggcatccttattaataacgggtgccatccccacaacagccactttatggtcaactaaccctttggcgtctaaccccttttgttcctgtgcaaataaatcagagttcccaatattgactgaacccttcgccacctgacttaagcctgctcctgaaccaccaccctgaacgttaatggtcacgttagcatgttcgttctggtaagcctgtccagcctgttccactaatggttgtaaagcggttgaaccagttgcaacgatcttagtagtcttggaactaccactactgctactagtactcttcgtacttgtggctgagctactgccgcaaccagctagtaaaatggtcatcgttactgccaatgcgccgagtgtcagtgcttttttcataattgaaactccccttcttcaattgactatcaaaattaagcaaccaacccggcaaccatcatagcaaaactgggtaggagtgctacgactagtgatggagcaacatcaccgtccgacggttacacgtaattgattgcttcggaacatgcttaatattactaatcgtttgtaaattgtgaatgacgattgtgtaaattgcttgtatagttttggtaaagttaagattgatgaaccaactgatgaccaactaaaaacaggcatcaccgctaatcacacggtagatgcctgtaacactttaataattttcaatgatttatttggtttttaatgattactcttggaggtcaaacgcgcgacggtccgtttgatccaatccagtagcggttgccgattgtcaccagctaatccgattgcttcaacgaataactctagcccaaataataaaccaatcgtcaataacacagaaccccaaatagatgagatcggatagagcaatgaaataaatgagaaaataagtgcaatcccataaattaccatcacagtctgtcgatgggtcaatcctaattgcatcaagcggtggtgcaaatgatgcttatccgcttgcgaaatgggcttcttattcaggatccgtcgaatcatcgcatacaccgtatccgtaattggcactcccaggatcataaccggaataccaactgagattaaggtgacatttttcaatccaaataatgagaacacagccgtcataaagccgataaacaacgaaccggtatcaccgagataaattctagctggaaagaaattatacggaagaaagccaatcatcgccgcaactaaagtaaaaatcaacaacgaaacgaacatattagcattcaagaagaacaacccgatgattcccatggtactcaacgaaataatcgaaacaccggtagctagcccatccagtccatcaattaagttcaccgcgttcgtgatagccagtatccacagtaaagtcaccggtaaactcagccactgaaagtgaatcagccccagcaacgggaacgtgaaggtcgtcattcggataccaccaataaagtagacctccaaagcggctaacgtaatccctaacattttttgccgtggttttagctcataaatatcatcgataacaccagtcgcaataatgatcagctcaccaccgagtagtgcgaaaaaaatgcgactgggaaactggtgcatgagatacaacacagtcgtcccaacggtgtaagagataaaaatagccaagcctcccattgtcggcattggaattttattgacccgtcgtacatttggtttatccacggcaccaattttaaatgcaagtttccgcacaaacggcgtcaagatcgcagaaagtatcatggtcgccactaggcttactaggatttcaaatctgatcatttgtgcgtaactcccttctcactctattacgataattatacaaatcccagtgacgcttgacaactcgcttcactaaaacttagtaaaggcaacacaattcgttcacatttgccggtcactgggctgattaagtatctaaattataaccttagttactcatattatgacacaaaaataatttagtgttaaatattgatcgctaatgagaacaagataaaaccaccaagtaacatggcaagaatcgccacgaccacccacaacacttgacggacgttgtgccgcacgcgtcgctcaacatggctctttgattggagatgctcatgttgggcattaaatagcgaagcattcgtgtctttgacccaatcagcaccatgctgaccatagtaggggttggtgttatgattgagcgagtgggggacccggccatttgatttggttaacggttgatagcgccgcatcgtaatcctcttttcaacggttgtttagtttttctgggccttataaggaacggcatagttcttaggggcgtcgctagcttttgcatacttccagtgcccagacatcttcttttcgagtggggcatcatctttgatgcaagtaaagcgagagccaacttcattttcgataatgaagatccggttaaactcgtgccgcgtctgaacaatgtgacaatcattgtgatcgataccaaaaacatctttgtataccaacaacattatctcctttggattgaatttaaaatagtgacaattttacaaggcttcacagacagtctacactatctattataaacccctaatcaagtccgtaaaccgttttgagtgaaaaaagataaaattgcactggcaagggtgtgacaattcataaaaagccacgcaggtaaatttgatcttacctgcgtggctttatccgtacttctgattgggtatactgggctcgaaccagtaaattacggattcagagtccgctgccttaccaatttggcgaatacccaataacaactatttaatagtaacttttccagcaaatactgtcaagactttgctgaaactttgtgtctattttttgcatttttgcttgaatatcgtatcagttggtggctaaactagttaaatggaaggtgagtgtatgtcgaagtcagaattagatcatttattcgatcatctgcgacaacaattgatcgtatgggcggtcacggccatcggattagcagttatgcgcagctttttgttaccccaattattgactttcgttttttggtgtagtgtggcctactgtttgctcttattcgttggtttagttgttgtgacgatttttaggtggcaaaaatcttaattatatttgacaagccgcttatcattcggtaagataataaatgaatttgtgcccgctggtcaaattggttaagacgtcgccctctcaaggcggagttacgggttcgatccccgtgcgggtgataagtcgacaaatatagagaaacgacaaagcaccaaaacgctgatataaaggcgttttggtgcttttgctttacactcgaaaaccactcaaacacgatatgttcttccacgattcttccaaaaacgaaaaaagtagtcaaaatatagcagtttttggaagaaaaattaacaaatgattttgtaatcccttgcggcacaagggatacagaaatcataaaattatcattttttaaaatccttcatccattagctcagtggccttcttatctgatacgccgttttcttcttcaataagatggacgtaggtgttaacggtcgtttctagtttttgatgtcgaaggcgatgttgaacatagggaagggactcatggtttaagataagaatcgaagcgtgtgtgtgcctcatggcgtgtgttgtaactttgtttatctttagacggttacaaatacgtcctagctcttcgtttgcattcccattacccacgattttccctagtttggaccaaaatactaggttcttagggtttttcatttcgtgtagttctaaataatctttctgcgtattacgatagctcctcataaaacgacagtaggcgggtcctatggttatatctccatcggcctgtccatttcccttagttggacgaaaagtctgtctacgggcgtcccactgctgtttaatgtgaactattccattattcaaatccaaattatcccacgtcagaccagcagcttcttcgaacctggttccagtttctaattgaaacagcatcatcagcatagtcatgtgatcataatcagccgttttaatgaggtatttacgtagcttcttataatcggacaacgtcaaatacttttcctctacgggcttaggagggcgtccagtgacgtgtgccttgtaagcaaagtctcgttttagaataccatctgctacggcgtccttgattgcagtgtgtacttgttgatgaagcttgtgagatgtggcaattccatgactgcggccaaatttattcaggaacttctggtaatctggacgtttaattgcgctcataggctgatctttaaaatatgcagagacgtgacgccagttgcccatatatagctcgtgagtatgacgcgatacgccgtcagttttgtaaattctgatccaatcaagaaagtaatgctttagactctcagtgctacgtgataagtcggcaccttccagcagagcattcttagttttagtttcccagtccttggcgtcggttttgcgacgctctgaatgagtgatagatccataagacccatctggcttcttatagctaatacgggcttgccatttaccgttatctagttttgtaattgacattggttgctcctaactggaaataacaatagcttggtatttccaaacgtatgttcttttttgcttttaaataaaagcccatattagggcttttgtaatactaaagatcaaagcgtctgttaaattcttcattttgctgcttacctgttttatcaatagtgatttttttgagtctagaaataaaatcaggcgctaagttgcaactttttaaaaagtgatagaatgcttgttttgataattgagttctagtattgtttttttgccacgcgtctaattgatcaattaaataaagggaatcaaatttgtccatcagtataattagggaaatgataaaagaaaaaaggtcatttttaccaattccttggctataaaactctgaatctgaaaatactttattactagcaaatatacgaagtgcatcatgattaaggctttgtctggaagtaaagtgaattaggcgactcccatgggcgagattatttctaaaatctacgataatggaaatcatatcgcgagtaagttcaatcatttccatttttgatcgttcttcaagcttttcgaaatcggcttcgttcaagttgtctgttgggcgataacggagcacctcattaaagacaaaatcagataaatttttatgggcagaaggcatggcgtcctgcattggtagtagttgttcaacaacgtatgttgttaatttgagagggaatattgaaaagtacattcttgtttgtcccatagttaggttgttcaatagaatccaaggggggacatcaccatattcctttttgtaatagagtgtcggattaacagtgcatttctccatttgatgagaaatgaattttgtgatttttctggctttagtataatttctataatttgaaaagtctaagtattgatctgtttctacaccaatatctttggatattatataggccatagattctttaaatatttgctcaaaattaattgtaaatttaaacagtatgtttcgaagatcatcttcaactctgtgatagtaatataaatctgtaatatggacattctcttcaaagtgtaaattatcctcttttgaaaattctgatttataccgattaattagattataatatcctcttgattttagaatctctatggaaagaaaatcgctatccaagattaaatccttatcacgtagtttattcaacatgtagcgataagtgtgaaattcaactttctttttttgtcccacgaaaaacaccccacaatagtaataactatcatgaggtgtttttacgacctgaataaggatacaggcatttcaacttacgttcatgatagagtatctgaataaaattgtcaattaatttaacaaaagcgagtgacgggaatcggacccgcgactacagcttggaaggctgtcgttttaccactaaactacactcgcgtgaatgggccttgttgggctcgaaccaacgaccggacggttatgagccgtctgctctaaccaactgagctaaaggtccggaagctttgcaaatgagtgaaaaagcaacacttatttgcaaagcgagaaaactaataatccattctggtaatttctggttctgaagttagatagtcactgacgtgtgctaaaaatttctgaaaatgaggagtgtcattatggaaatccacggcttcttgatctttccagtgttcgataatttcataatcattatcactgtctaactttttgaaatgtccatagaattcattaccagcttcttgtgctgaattaataacaagttcatgaatgaaatcttcatattcttttttgagttctggtttaacatgcaatgcgacgttgataatcttcatttggaattcttcctttgaaatttagttttattattcatcatctgagtcttcgatgagctctagccaaatggttaatggttctgggttgaactctggccactttttcataatctcgtaagctctactcaaaacatgactttcgtttccttcttctaagtctttaaaaacacttaaagcgacggggttattagatagatcgtccattaaaatatttgttttatgttgccattcggtaactaatttttggtaatttattaaacgtcttgcatgctgaatagcatagtctacaccattttcttgaactcttttaataaaatcttcgtactctttgaagacagcagactgtgcttgtttccaatcattagtaggtaaatcttctgatttttccataaatggcacctgatttcttactgcaattattttttctgttgctttaataatgatacaatttctgaaagatatttttcctcagctgttggaataggatcggcttcgacatcctctttcttgggcataattttattaatcattttgactagtaaaaataccacaaatgcaataatcaaaaaattaatgacagaattaataaaggaaccgtatttaaaagtagcattgccaacttttaaaacaaggctagagaaatcgatttgtcctaaaaaaacacctattagtggatttattaaattattaaccaatgatttaacgatagcagtaaatgcagccccaataataacgccgactgctaaatccattacattaccacgtgagataaattctttgaattcttgaatcaattaaatatcctcctgaaaatatattttagcttttaatgacatcctgactggtcaatgtgagtggcaggagttgaacccgcatggcaataagaaataagggaagggtatcccataagaagttgccgttctgccgttgaactacacccacgtttgtaatcaattagtgatgaagctttttatagagaaaatatgcaactaatactgatataattgtcacaaataatagctcagtgctccacttaatagaggacaggctttttaaaaaataagttaaagaattgaacattggtgattctcctatgtttgattgagttaagaacctctatgcgagcggcaggagtcgaacctgcatctgttagtatctagtcagcaacttaaaggagcactgttctaccgttgaactacgctcgcaaatggccaatttgaaatcaaattggcacttgattaactacaattatttttgttctaaacgaatagataaatcttgcttcattgcctgaagcatacggatgtattcttgttccgaatatgtgtctttcgttaaatgaagaatagcctctgcttctacaaaagctgttaaaccattagtgacaagctcaattaattcatactttgaaatttctctgcccatggtatttccttctttcattttattaatgcgagcggcaggagtcgaacctgcattggaaggtaggctatatttgaattaaaggaaccattctaccgttgaactacgctcgcaaaaaaacttgcaaatacgattttaagatctataatgtttctaagcatgtttcgtacatgccccttgaggtacattctctttcgtggtgagggagaatgtatttttttatgttaatgcgagcggcaggagtcgaacctgcataaatataggatgtgagacttgtgagaagcgtgtaaataactgttctaccgttgaactacgctcgcgtgagagcccaactatgggccaaccatttacagttaatcttttttgagatttgtgtatgatataatccaagaccccacagatgagctagctttcttaactttcactgtaactgtttcacctttattcaccttgggattttcagaacttacgaaattcaagtgtttaccagtttcaagattatagccaaatgcgctatttggaacaactttattgaccttgaattgaacggtttttccttcaatatctttattttcatttaatactgattccgctgttgaagcagtataatcaggctttttgtttccacaaccagccagtgtgaaaattatagctataatggctacaaaaccaatactcatctttttcataacaaattctccgatctttacatggtttattacggttagaatcaagccaatattttaatttacagaatatgtttttgtcccaatagtttggaaattggcgttattgaatttgaccgttacattatttttgttctctaacttgaacataaccgccgcctgcgttgttttccctggcaacaatttatcatttaggccatcttcgtatttttgtattggattattaccgttatcgtcatatttgggtgtgccgggcaaaagttgtttgtttgctgtatctgttttttgataagcatttactacagtatagatatttgaaggatcctgttcctttttagagttgttagtaacgtcacaatagagaactaaaattttagttccgtcttcgctgccatcacggatttccgatttcgtaaatttataagtttcaattccggctgagaaaacattatctttaaacgtccatttgtcatttgacggatcagtcgattttgttgatgaaactttttctgccttggagctattaacggaattggttttagaactattattatttccgcatgcggtgagcgacaatgcggttattccagctagtaataaaacactgtattttttcattgatgtttcctccaatataatttattccccaaatccaatttcaataacattattgctttgattctgtgctaatggctaaactctctcgatactcttcggcctcaggtgcttctttgaaatctacagtcagatggctatatttttttaactcatcttcaatttcgtttatagaaattcgaaaatattctttgcgattattaaccatattgacgcggctttgtgaaaaacactggtgtagctcagactccaattgatatgcattttcgctaaatatcaatgcatgtacatcaaacttaaatgggacagaagcacttccaagctcgttaatccgatccattggatctaagcggcgagttacgccgattttgaaaacatttttaccaaatgaaccaacattagaaatgatataaacatatccggcggttgcgttttcttctcgataatcaacttctgattttttatcttcatactgctttagcttttgttttaactgctcgatttcatctttcaatccttgattgtaaggattttcgatttgtttttcttgtagttcttgaattgctttcgaataatggtcgatttctttattgagcattttttgttgagcttttatttcccgttgcaaagttttttcttctttttctcgtgctcgctgctcacgaagtttgtctttttcttcttgaactttttgtcggtactcaaatgctagatgaagttctttcagtttgagctgtaagtaattgttgaccatacttatttcaacaacctcatacattttattgtgctggttgaatgagcgaatgatccttgtttcgatgcgatcaaaatttgaatatgacactttgtttatagcatctgtgcattcattattaaaactacgaagaatcgcctttacattgtttcgattcatctttcttccctgtgctacgcttccattgacttgccagtgattgttaaaaatacaagcggttttatttttgattagatttttttgttgatcgcgtatttcttgtaatttgttcttgtagcctaaagaatccgaaaagtcatattgtggttggtataagccatatgaactcatttctaaatcaggagaaaggtcactaatatcggcttttatttcattaagcgtattggattgtctctcaatttcagaaagtacatcgatacattttttgttagcagtatcaatctgttcgtctaactcatcaagctttttttgcttagaattaataagttcttcaagttgttcaggcttcatttgttgtaatgacagcttaatatcattctgtctcttcaaatcatccatggtttcttgtaattcaataatttcaactttggatttttgaatagtatttttaaatgcgcttattctgaataagtcacctagtgacatgaaaattcctccaaattaatttatctataattaatctccgtcgaatggtaccccgtattgataagacagttcttgatatgaatagggaatatggccattctcctcaataaacaacattcccatcaatccaactgaaaatttatcagcttcacgttcaaacttagaatgtccatgtttaacggaagtgtagtacccaatcagtccctcatggaatataacgtgtcccagctcatgaccgagtatgaaatactgtgtaggcgtgtgtttaatagaattattgagtagtatgataggctcttggttgtcataagcatttttacccagaggcattgccccaaaatcacaccattccacttgtatgttaagcttttccgcaattacaaacgggtccgcagtgtgataacgattgacaatagttttaacaatatcttttactctatccataagtacaactcctaatcatgcttgtggcgtttccagaatattgttgccatggccacacgcacttgttgtttttcttcttcagtaagatcttcaccaccataggtcattgagccttcgtttgcttcaaggaagtccttcaggtcaatagtatctttcttggttgcccatttgggggtcttgttattacctaaaagatagtccgtggttacaccataaatatctgaaatttttgtcaacatttgaagatcaggttcacgtgtaccatattcataatttgcgtaggttccgaggttggatatgccaagtttttttgcaacataagttttagtccatcctttttgttcacgtaaattagtaagcttattgcttaattcagacatttatttcacctctttgagtagattatataatagttaaacataatatttaggaaaataaacaaaaagtgtagaaacggtattgacttacacttaatgtgtagtattataaagactgtaagttaaacataaagtgtagcgaggtgatattaatgaatgttccagttgtaaaaaaagacgctaatttagttctcagagatattcggaagaagaaacatttaactctcgcagaattagggcattccatgaatttgcgttcaggacaggctttggcaaatattgaatatgggactaacaaattgactttggaaaaagcttttttagcagctaacgctttaggagttagtgttaacgtttttttacaagcaaaagttaaacaatatgaatagaatataagacgccaaaatgaagccaatgaaaagtaaaagagccgctatcgcaaatagcaactcttcggattaaacgttaatgactgacaatctttaccactttggagctggcaaacacggtgccagggtcatcatcagtgaaaaagaaagtgtagttgtttagaagtttggtgatacttggcactaatcctagcttaatatgttcgttcagttcaaacggaccattaatttcgtctttgttaggaaaatcgtacgttatcttttcccagttctttttagaaatttttttaggacgatcattaattggcgcagtgcgaataccccaaacaaagtcatgtacgtttagcgttagtgtttcaccatctaaaaaatgaatcgtagctgttaacattttttaaccacctttttaagtgagaagtctatggaaattatttttccacctcgttgtaaggcgggaagtcgaagaagtcgtgaacgctgataccgagggtgccacataccttacggattgtagtaattgttgggcgcttacttctcccttcaaacatcgcgtttacagtcgactggttcagcccagctaatgttgcaacacgattaatagttaagttctgttgagttattaattccattaaatgttcggaaacaaattctccatcggttttcatgttatgagctcctaacgatatattgttaagttcattctaaagtaaataacaaaaatatttactaatatattgttgacatgtaacgatatattagttattatatggtcgagttaccaatatattagtgactagaaaggagataccaaatgacttacacattaaggattcgagaattgcggcagaaactgggactcagccaatcagcactagctgataaaagtggagtaccacaaacgacaatcagcgcaattgagtcaggtactaatttgacatacgagacggcgaaaaaacttgcccgtgcattaggagtttccacagatgaattatcggtggaggtggccaagtaatggaaattacgcaagaacaattgcacgaaatggtccaatcagaggtaaacgcagctattgccgccaaaagcctagcaccagtcaaagcaagaaacactgcttggatagagcttaaaaacgatatttcgaaatttgtcaacgagaagtacggtaagaattcaaaagcttattcattgtcagacgcagttaaaacaatcattaggttccatttaggtgtgtctaacgtatatcaaattaacgagagcaacattgatgaagcgcgtcgaatattcgagttactaaacgcaaatatttaattatcaaagaacggaggaaacaaaatgacacacctatcacgaactacattaatcaatgcactggcaaaggttaagccagaaacgccaagagtaatgtttgaggcactaagcgataaagcgctagatgctgaatttcgagcggtaacggctgagtataacgaacaagctagccaacttatgtcagtttcatattaggaggtgcgaacatgtcagatacgatattgattcggcatgaggctccaaagggcttccaattcattagcgaagaagaatacgagaggttccaagcctggaagcaagcacaacgtggtattcgtacttggaagcttaaagatttggctaagtataaatatggaactaaatcaaccgaacgagcctcacgatatttaaccaagcatcgccatgatttggatattgaacagggtggtttcattgattatgtgaatacccataacggctggcatattccagcagctgagatgatggattacctattagatcatcccgattaatttaaattataggtgaattacatggaaaggcgatataaagccctttccaaaatacagaggtgtaggtatgaagaacaagtttgcagagcaattgtcattggcattaggtagagataaaacactaacacaacagcagattgcagataggacgcatgtttctcccggacaattgtcccggttgaagagtggatcaagaagcactgatccacaaatcaggaagtcgttagcaaatgtaattaacgatttttggcttagctattctggcgctcgtgagaatttcggcgtgctgtcattccagaatgacaggcgtctaaagggcgatatgttctcagccctaatgcgtcagaagaaagagcagcaagaacgagaggcaatggaagccgagtttgagaacgctattgcgattaatccaaatgatcggacaccagcgcagcaactagttattgaacgttatccacgtgaatatgcagaagagattagcgccgaaataactgatttggctaagaaagctgagtatgccggtataccaatggataaattgcaggaagtaatcgataaagtcaaccaagaaaatggctaggaggaaatagcaatgattgaaggagcaatagtaggctgtgcgttaactgccttgtggttcaagcgtcatgaagttgctagttggtttggaatttaaggagatgaagacgatgaaattcacattcaggattggaaacgtgctttacaaacagctcacgatcgaagaattgaataatctttttgacaaatttaaggaggctgagatagttggaagtacgcaaagtatcgctaaagcctaaatttgagtacgaaaaaagctgctcgagtattggtagtacccgtgcagcaaagacgcttaataattttattttcgagttctattgtactccgaaattgtcgttaagacaacggttagcacggaggtgggcaaaatgaacggctacgatagctggttaattgaccaagaagaagctgtggaaggctggcgtgatgatgtgcctactgaggaagagctgattgaaagtggcgtcattgctggatattaaataggaggatttcaatcatggatgcaatgttaaaagaagaacttagaacggtgacagaacgtgaaaacgaaggcttcaaaattgactcattggagaaagctgactgggcgttaaagaagctcaaggctatccaagcgcatgatgatgaaattggccaagttgcgaagaacaatattgaccaggcaattgcatggcgcgacagggagcttgataagaaccaagccaaccgcgagtacttcgaagggctactgaccgactatttacgtgatcaacggttagtcgataagaaattcaaaatcgatactcctaatggccgtgtatcaactcgtaagaacccggctgggttggcgtatgacgaaaagatggttttaaactcacttcgtaatcagggcatgagccaatatatcaaggtcaaggaatctattgataaagtcgatttaaaaaaagctggtcgcatggttggtgacaagtttgtcatggaagatggcgagattatcgctggtattactgaaaagccagcaactgagaaggtcacgtttaaatactaggaggaaccgatatgagtgaagcaatcgcgaaagcagaaaatcaaacgaacagtttatccctaatcatgggtactgatcaaaacaagatggctagcgaactacaggctatctctaatttccaaacgatggttcaacatcaactaaaagatggtcaagattttggggttgtccctggcacacaaaaaccgacattattgaagcccggagctgagaaaattcaaatgctgatgggggtaacgagtgaatataacgtcattgataaggttgaaaactacaaggatggttatttcgactataccgtcaagtgcgtgctgtacaagagtggtatgcagttaactgagggattagggtcggcaaacacaaaagagagtaagtacgtttctcgtgatggtttttcgatgaaaaacacggtactgaagatggcgaaaaagcgggcccaagttgatgctacgctaaccattgctagcttatcaaatgtcttcacacaagatgtcgaagatatgcagaattttaacaagcgtgagaataacgaaaccatgactcatgatgaagcctttaatttaaaacttaactttggcaaaaataaaggcaagagcatgggagatgtcatgaatgagaatcgtggctatattgaatggctagctgagaatgcacagaaacctgaatttaagactgctgctaaattattactagctggcaagcaacagcccacaactgacgatgaagtaaatgaagattttgatcctaccaccatcatcgctagttcaaaacagacaagtgagattgctaaccttgctggtgaactggccacccaaaccaaaaatggcacaccattatcagtgactaatgaggttattcaacaaattgtccctgattggaaagggactgacgacgattggaagaacctaacaatagcacaagcagaggatgctaagagtcagctacaaggattgctagcagcatttgataagaaataaacattcgaattggcttgaatgcagcagtgactgaatccaccaaatgggtgagaggcccatcaataaggacaggaggtgcaagatggcccgtccagtaaaagagggattggattacttcccattagacgttgattttgctgtaaacgacaagacagaagccattatgggcgagtttggaccgaaaggtgttctgtttatgatttatctgctgtctgcggtgtaccaaaatggatactacttgcaatggaataaattgaaacagatgcagttagctaatcgaattgaaggcgtatcacctgaattagctaatcaaatcgttaaccgcttgattgcttatggaacctttagcgaggaactgttcaattcggctaaggtattaacgagccagcgtatccaagagacctatgaagatgctactaaacgtcgcaaatcacagaaaccaaataagtattggattaatgttgacattaataaagatacaagtgtagttaatgtcgacattaatccacaaagtaaagtaaataaaagtaaatcaaataaaaataaagtaaataattatgatgatgacgcgggcgtgacgcgcgagcaggtcattaacgattggaccaacctgtggggatttccaaatggtattgcccgacctgagattgatgaatggctggaagagttcaagcctgaggtgattgcctatgcaatttgggttgctggagaacatcagattggatctaatgcatgtttgaaatacgttcgtgcaattgttgcgggctggaagaaacgaaatattacgacgttagagcaggctaaaaaggctgctgctaatcatgacgaccgcatgaagagcgaaagaaaacctagtggctattcaaagccacgccgtaaagaagttacgccaaagtggatgcaaaacggcgcttctcaggcggattataagccaaactcaagcgataaccagcaggaagatatgagtgacgaggcgttcctagtgttcatgaacagtcaggaggaagctaaatgaattggggcaatcaattagtcaagttagccgctaaccatgcctatgaatcatcggcactgcattggactaagcagcgtatgaagcggcatttaaaggccggtggtagtgcgcaagatgaggtgtgcgctcatgagtacaagctatttgcactcgaggttttaattattgaatatcagcgggatggcttaaattttgatttgacccaatgttggggtaagccagccgagtattttattgatctagagcaagctagacaaggattgcaaacggaggtgagcgcatgactgaaacacaggtgctagtaattaacgctgatttacccgatatcgatcacccactagcaatggggacagaaccggaaatgtttaagctcgcgcaacataactacaaatctggtgaatggccgtttccagttagacttgtgaagcctggaactaagccatggaatgatgaggcctatctagccagtatgcaacccaatccacagactgaggaacgcgagcaaatcagggccattcgccgcgcttaccatgatgactgtcacacaattagaagcctagccataaggacggggtttactaaccagcaggtaagtcaccttgtgcataaatacagccttcgcttgcgtaaccaatactggcgggctgagaagtataacgatccggacgacgttatcacgggtcaaacgatatatatcttaggtgacaagcttgaggccccagctgactcaatcaagcaggcgagtcaatcgaatggacttgtccgtggctactacattagccgggtgccgcgagcatgagcaaagttgtgattaagggcgaactaccaagtttaaatgaatacatcaaggctgaacgggccaacagatacgccgcagctaacctaaagaagcggtacacggccttatgtagtgtatatgcgagagctagtcggaattccggagctgaattcagttggccttgcaagcttaaatttacgtggtacacgaaaaacagccgaaaagacgcggacaatatcgcgtttgctaaaaagtttgtgcttgacggctttacgaaggctggacttttaggcaacgacaatcgaaagcatatcacggggtttcaggacgaatttgcaattgacaaacgaaatccgcgagtagagatagaggaagttacggaggacaaagatgcctaaacacactaagaaatgttcaacgattaaacggaagcgccggcgcatgaaggaacacgccgaagcaaataaaaagccaaccaaagaggacggaaagtaattatgaaattaaagattgaaaacaatgatttgaccgtaacagttgaagcaactcgtgaattgagctttgaggaagtttttaagtcacatcagctggctactggccgtgatgatgaattgagcactggtcgtgaagaaaaacatatgtttactccggaagattcaaatggactagttaaggatgctaataccgagtctgagttcattccggcaagtatgcccaaaaatggtgagatggtcaaagctgaatttatttgtccacagtgtggctacgataaagtgacacatgttaagtttggctttaaccactggagttgtcctggctgtggaattagattatttctagcgtatgcaaccggtactcgtggggaaaaagatgcaaatgggttttactacaaagctaatcgagaatttattagtcatgcacctgaaaacagtgatgatgatttttccaagatgtttacccggtcagataatccagagaagccggatgcatatgacacaatcccggacatcaaaaagtatcttgataagcacggcattgattattcccatgcaaagtttaaaggtgactatgttgatttaattccagaggattaatcatgataatcgtcaagaaaccaactaacgaggaacgaaagcgggcgtttgaagcgttcggggaggattgaaaatgtctgacgccgaatatgccaaagcaatccaagtaaaagccgcggttgccaacctggaaatgaacgcggcactgacaactgagcaacaagcacaaattggccgggactttatagatgatgttgtggagctgagtaatcgcggtagtaagatagttgatcaataaaaaagagagcaaaactattaatattgctctcccaaaagttagggtcaatgaggtattagaaataagatatgagaagaaattatgataacagaatggcggttgaaattatgataagcattatcagtccaaaaatccaagtgaatcttgaagtttttctaatctcatcgagccaaaatgtcataaatcattcctcctgtcttaatttcacttaaagaataacaaaggaatgtaaatactgaatatcaaatatgtaaattatttgtaaacaaaaagccgcctgttaaggcgaccagtcacaggaccactcgaatgaccgttgttagtataacatataaaaaagccctcacatcaatgaaggttgacgtgaggatggggggacttcgttaaagtaagtccttcgttattttacaatagagcatgtattttgacaataataaataataccaccatttaggacaggagtgaccggtaatgttgccgattgaaattattgaattattggcgcctaaactgccatttgaacttttgacggacttgaatcagcggatgctggattggaaggctagcggaggtaatgacacggatgcttacatgtaccagcaatccagagtagcagaaaactattaccgtctggctttgaaaatcgatcctatggcatatgaagataaataaaaaagcgccatcattgctgaccgcgctatgattgattcctacaaaattaattatagcatacgaaagcggaggggcgcatgatgggcgaacagcaagttatttcagatgaaatttttccaccaattgaccaagagaaaacaattaaacaggtgcggcggttcctggataagaagttaccgcaagcagttcgggcgtccggccattcggtcgctgatttaaaatcgcctagcatggatggcatgcctaagtcggccccagctggtaattcggccgaggatcggattacacgccgcctgtatgcagagcagattgtccgacagactattcaggccatggctagctgtgatcatgagtgccaggagatattagatcggctatatctgcaaggatacagtgacacgatgtgctacatggatattggctacagcaagactcagtattttgatcgctggaagccattggcaatgctgcagtttgcacagagctattacctagaagacctgaatatttatcaaaaccggactcagaccggactttaaccgaactttttccgaactcaagccggacttcatagcaataaattggtggtaaattagtattatcgataattggttagggcgacaaataaacgtttttctgatagctctaattgattattattgtggccttagctcagttggtagagcgcctgactgttaatcagattgtcgctggttcgagtccagcaggctacgttgccagcggatttataaggggtgatgcgctcctctctgccgctggtatagtcttcgtgtttgacgtcggccgttaaatgcgagtatcgctgtgggctaatttgtaagccacaatgggatgtaggttcgagtcctaccggcgatattgttaaattaaaattaaggaggaatcggttatgtttaaaattattgaacaactagtaaatgaggttttacatggtcatttggtatcaattaacagatcaaatgaaaatttggctgatggtcagacattagctcactatgatttcaatgttaaaacaaaaacccccaccttaaagtgagagttctttaaactagaatctaggcaaactgagtagattgtcataagtcgtttggtttgctttagttcttatatatggatcacggtaagtgggatgcactgtttcaacttcggttttattgccctcacgtgaagtgaaataatattcaaggctttgatcaataaaagtgaccacttgcgcaacggtttcttcactcccatctgatagttgaacctttttaatatcagattcgtcggtgtcaaaactattgtccgtatgaactttaactatttcatatgacatattcctctctccttttgttaaagataaaataagtatacatctatttgatagcattatgaatcacataactagcgtttaaactggccaccaaattacatgcggaaacatgtgcgctgtggtaacataatcaaacatggttacaaaaactataatcgtttttctgatagcaaccgtgtgtgggagcctgacatttaattgggctctttttagtaaaataaatagtgtgtattgcaacttaaataatgttggatatagtatgatataaaattgtattgttgaataacaggatcgccaccttatgaggcaacaatacatgggtctgacttatgtcaggcttttttgatacataaaattagggaggtagcggcaatgccatgtgtgatacacagcaaatatgggtacgagccgcctgaatgggtacaggctggctctcggctaggtagatggtacaaggataagaagtgtcgtgcaaataagcatggcgcttttagtttggatacaaaaaagaaggcgatcacgccttcaaagaatgttacttgtcaaatttatctttcagattgtcaacagcatctttagccgtatctttggcatcagctaacttatccttagccttgccaactaagccttcagccttgccctgggcttcacgggttttgtcaccggttgctttgccttcaacttccttggccttgccgctaactttatctttggcgttcttagctttgtcgtctaaactcattttgtagcctcctgataaaaataattgtgaagcgtaattgttcgagtaaaaaggtcactgttttccgccagcgacctaaaggttattaactggataacccttgaacacctatagaataaattggtcttaattgaaagtcaaccaaaacggcatgttatgtattaatttcaaacccgtcgatttcgactgggttaaaaacggaggtgaaaagtatgaattttggagaagcaattaatgagctaaagcatggaaatgcggtcgcacgtaagggatggaatggcaacggtatttatattaaattgcagaagcctgatgaaaattcatttatgactcatgagtacgtttatattgatacaactggtttacacacgaacaatccagatgcacccatggatcgtgttccatggctagctagtcaaactgatatgttagctaacgattgggtcgtagccgaatgacaatatataattccaattaacggaggtgtggtggtatgtaatggataaacgaaaagcggctggtaaagattacgcggccggaatgaagtacaaagatatttcagctaagtatggtgtaccgattggaacgcttaaatcatggcgaacacgcgacggttggaaaaagaatgcatccacagttaaaagagtgcaaccaaaacaaaaaaaagatgcacccaaggttgcacctaaaataattgacgaactagaggcaaacagtgagcttacagataagcaaaaactgttttgcctcttttatttacaacgatttaatgcaacgcgggcgtatcaacaagcctataaatgtagttatgagacggcaagggttgaaggtagtcgcaccctcgcaaaccctaacataaagaaccagctcgctgagctaaaaaagcagcaacgcgctgacctgtacgttaccgctgatgatatcgctaaggagtacgccaagcaagcctttgctagcctgggtgatgtattggattacaaggttcacgaagagacggtgcaggatatcgacggcaatgtattcctagacgtggacgataatccagttaaaaagcatgttgcagatatttatttaaagccgagtgatcagatagattggacactggtacaagatattcatcgtggtaaagatggcttagtcgttaaactgtatgacaaacaaaaggccttagacagtctggctaagcttttctgcaatgatggtgatgttgctaagcaaaaattgcgaaaacttaaatctgaagcagatattgttgaagccaaggcacaaatttttaatgataaaggcgacgatacggaaactaaggtagctaagttgttagataagattgatgacgctattgaagggaatgatgatcacgataactaacttgtatacgtcaaagcaaatcgatgtgatgaaaacggtattgcagcggaatgattggcggttgttgattaactatggcgctgtccgttctggtaaaacagtaattgataatgacatcttcctaatggaattacggcggatacgtgcagtggctaacaagctagatattgatgagcctatgtatattctagcgggctattctagtaaatcattacaaaacaatgtgttgcaagaactggcaaacaagtatggtatcgactttcaatttgataagcacggatcgttcaaactattcggcgtgaaagtcgttcaaacgtttactggttcaattgctgggcttggtgctattcgtggtatgacaagctttggggcttatgtgaatgaagcgtcgttggcaaacgaagcggtatttaatgaaattcttgaccgttgttcggcacctgatgcacggattatttgtgatactaacccagatgtaccaacgcattatctgaaaaagaactatattgataataacgatcctaaggccggcattgtcagttatcattttacgattgatgacaatacattcttaccgaaagagtatgttgagcgcaagaaagctggtacgccgtcaggaatgttctatgatcgctcaattcttggtttatgggtatctggtgaaggtatggtgtacaaggacttcaataaggatacaatggttattccacgttcgaagttaccggccaacttaaattattattgtggtgttgactggggctacgaacataagggaaccatagttgttgtggctgatgatcaagttggcaatacttatttgattgaagaacatacacgtcagttcgaagagattgattactgggtagcgattgcgaaagatattcagcgtcgctatggccgaaatattaagttctgggctgatagtgcgagacccgaacatgttgcgcgttttcagcgtgaagggttcaaagcattcaatgctaaaaaatcagttttatcaggaattgaatcggtggctaagtgcatgaagcaaggccacttttttgttatcaaagaagcgattgatgcgttcttagatgaaatttatcagtatgtatgggatgagactacaggtttacccgccaagcttaacgatgatgtaatggacgctttacgctatgccatctataacacacacgaacggctcaaggcgcggacaattaagaagccaaagggattaagaggataggaggtgagcggatgcaatatgatttgaacaagaagcgtgggtccaatgttgcgattgaccgtgaattggtcggtaatattgaaaatcctagtttcgaagtgattaattatgctatcgatcaacaacggaaacgcattggccgttataacatgttggaacattactatgagggcaaccagcatatcttaaaccgtaatcttgagatggcggctaagttggatcgtgcagatgaaaaggtaatgacaaaccacgctaaatacattactgacatgattaccggttttacaacgggtaatccagtatccatttcaccggcgaatggcaaggatattaaagctattacggatgctcaagaccagatggatattgattcgcataatacggaaatggagaaagatctaagtgtgtttgggtgtgcgtatgagttgctttacattaaaaaagtatcagacacaactactgagttggcaattgaaaagattgatccgcgcggctgcgtactggtaacggatgacacgctggataaaaatccactatttggtatttactacgtggaaaagaaagatctacgtggtaatgctgatggttatctaatcactatctatacggcccactggattattcagtatcgaaccaagacgggacgagtgttatcagatgctaatttagttagcaaacctaaggccgttcaacactattttagtggcgtcccgctgattgggtatcgtaataacgaagaacgccaaggtgattttgagcaaacgattagcctaatcaacgcctataacgaattacagtcagaccgtatcaccgataaaaagaacttcgtggatgccttgctggtagtctatggctttacgctagatgagggcgaggacggtgaaggagctaacttgaaggatggcatcttagaagcgcctggtaagggcgaccagggtgctagcgttgaatggttgaccaagagctttgacgaatcacagctacaagtacttgttaagtcgattaaggatgacattcatcaaacgtcttacgtccctaacatgaatgacgaaaactttgctgggacgattagcggtgaagctatgaaatacaagctgttcggcttactccaattgttagcgactaagcagcgatacttaacgcggggtattcggcggaggctacgcttaatgcagaatattatgacgtttaaaggccagtcggtagacgcttctggggcaacaattaatatagttcctgatattcctgtcaatatggcagatgtcatcaataatattaagaatgctgagggtgttattccgcaattagtgtccctcgggtggctgcctgggaccaatgacccacaagcgttgattaagatgctggatcaggaaaaggaaaaagcactcaaactacagcagaaagctatgggcggcgagcccgccacagataacgaggaggtaactgcggatgattctggcaacgtttcagttaaacaaaaagcaggtagtgagttatcagataacgggccacgcgaatagtgctattaagggccatgacctagtttgtgctgctgtttcggtgcttggccaagccatcactaatgagctatctaacgccactgttaacgaaaatggtggcttgtttattggattgattgagcccagtgctgataacaaagttctgtgtgagaccttattacacggactacaagatatttcagcacaatatcctcagaatttgcaagtggtggtgaagggcaattaactcagaattgaataaaatcattaaaacgattggtgtatttgtgatcgtgataattaaaatgcttggattagtttcgcttggatggaagccaattacaggcattttaattttgctatatttgattttataagctcggaggtgtaggagtggcggatgacaaacgcaagttaagttactggcaactgcgagccgttcagagcgaacagaaatcacatgatgctgcaaccaaacaagcgactatcattgcgagagcgtacatgtgtgctcagaactatttgactggtgaggtatcacagatatataaaagatattttacggatggtaaaacgacggagtccgaggcgcagcagattcttaacacgaaagtcaatccgactgaactagtaacgttgcgagctctggctgataatatcaatgatgaagagtcgaagaagcaggttaccaactatctatcacagatggcagctaagggacgtattaccagattggaagaactcaaagctaagagttatattgctgtgaaacaggcgtcatccgtcgagattgagaagtctacagacctttataccagggtaattcaagatgcacttgatcaagcaactagcgagagcgttattggtggctttgataaagacgtcgttcttccgagcgtgagtgctgctagtcagtcaaaaatacgcaccagaactatacttgaccccaaaacgggtaaagagatggtaacagtaaaggcgagtccagacgaaccaataacacgatttaaagaggtgtctggaaagtatgttaaggccgcactagacaccccgtttatgggtaagaactattctaagcggatttggcataacaccgaccaactagctaaccgacttagtgaactattcactgcacagcaaatgagtggtatgcgtgaacgtgacatggtgcaagctttagctaaggagtttggagctagcagctacaatacacgacgattgattagaacagaagccaactactttcataatcaaacgaagctcaatgaatggaaaaggcgtggtgttaaaacgtaccaactggttgctgtgctagatatgcgaacgtcaaagatttgtcgaaatattgatgggcaaatatttaatgtgaatgaagcggaagtaaacgtaaattttccaccgttgcatccgttttgccgaactgttgcgatcatctatttgtcagatagcaagtacatgctaccacggacggcgaatgatccaattactggtgaaaagctcaagttgaagcctgatgctacttatcaaaattggcgccaggcagtaatcttaaagcatggttggcaagctttcgataatttggataatcaaattggaaatcgtcggtatgattctacccagtatgatgaatacaaacgtattttaggtgcagataacgtacccgaaacattcgaagattttcagacgatgaagtataatgacagtgatagttaccaaagcctgtttaaagtagcgcgcgaggttcgacgcgaacaatttgcgttgaacaatgtacacaattttggtgaggtgcacggtgttccgtatcaacaggaagctaactcagtttttgaccgttatgtcgatgggcaattagttgcgcgaagatattatggtaagactggaaaggcccggctggacattgattttaccgaccatggtaatgccaaaatacacacgattgtgccgcatgcgcatccctggttacacgttacaaagaaaaatggcaaggttgttccccggcgtgaagaacctgggcggaaattaacgattgcagaaaggattgtgaataaagatggtggtaagacgagtaaaagctgattcggatcacttagagtctttggagcaacttcgatttgcattagatgttcgtatggaggttcaaatcaaaatcaatgatgttgagtggtacattggttttgatagtgagggcaaacgtatcatttctaaaaataatggtgattttgattatcacttcaaagatactgacgatgttgatgagattcttgattatgtaattgatggcaagaaaatccgtgaccaatggcaagatatcgttattgttgcaatgtagggcgttcaaccattttgattgggcgttttttagtacgacgaggagaatatcatgagtaaagagaattcggatttaatgcgttatacagagatggcaatgaaaggcctgacttttgatgatgacacggagcaaggctttaagctcatgacggatgcatttctaacatgttatgaagaagaacttaataaaggatatgatcaagtaacagcaatacaaaacgccacgatgatcctttcgacaatgtttcatcaggattagcatgatgacctaagcatgtcgttaaactacttaaactaaatagcatgcgtgggtctgataatgacgccacggttaatttagcacaatgtgtggggccttcgggcaatgcatggggtgctttttttgtggccatggttattggaaatgcgtgggcatggaggaatctaattatgaagaagctacttaaactaaagatggatttacagatgtttgccgatggcggtgagggtgccggtggagaaggtggtggcaatggaaccactaatactacgggtactgatgctaatactgatcaaggcaatgataaggacggtgccaacaaagatggtaagggaggtactccgtttaaatcgtttgctagcgaaaaggactggcaatcaagtgttgataagctgattgcttcggctatcgaaactcatgataagaaacaggccagtgaagtccaacgacaaaaagactatgacaaaatgactgacttagaaaaggccaattatgataaagatcaattgactaagcaattagctgaatcacagcgtcatagtacgattgttgaaaataaagctaagttaacagaacgacttggttctgatgatctaccaactagtttgattgcagcgtttagtgatgatgtactggctaatgacgaaggcatcgaagaagcctatacgaatattagcaaggcatttaacgagagtctacagaaagctattgataaacgtattgctaacagcggtacaacgcttcctggtggtgatacatcagtgaataaatctgaaggtgcggcagctgccgaaaaattaaataactcgcagaaaccagctacgtccagtttatgggcaacaaaataaggaggtactaagttatggcctatgtatttgataaaggaacagtagaacaaaagaattttatggcatctgaaaagttcgtgtcgttttcacgacaagttgatgatactaactatgcgggagttacggatcagcttggacataaagttattccagctggcaccatttacccaactaatgatgctaaagccgaaggcgtcacaattgatgaagttgacgtcacacatggtgctcaaatggtcggtgtcattgtagaaggttacttgttagggcaacgtttaccagttgctcccgcagaagcagctgttactgcactaaagaagattacctttactgatgtgaataacaccacaacatcacaagcctaatttagaggaggacaataaaaaatggcacaaatttcagatttatttacccaacatgatctaattgattatactttaaatcgtcaatatccagacatgcgcggggatgaacttttcccagctatcaaggtcaattctctgactattgatattttaaaacgccaaaaccgtattccagtaattgcctcatacgcggcctttgatagtgaggccgaaattggtagtcggtctgcttctggtgctgctatcgaactagccttaattaagcgtaagatgcagattaaagaaaaagatttatacgccatgttaaatccacgtacttcagccgaagccagctacttgaaacaacatgtttataatgattttgatgtacttaatcaaggcgttttggcacggattgaaaagacggcaatggacgtgctggcaacgggtaagaccgttttaacagatgagagtggtaaactggcagttaagcttaattaccaagtaccagcagagcaccaagaagctttgactggaacggctacttgggataatgcagatgcggatatcattggtgatattacgcgttggtgcgacaagatggatattacgccaacccgggcactgactagtcggaagatttaccgtttaatcacaactaatgctaaggtgttacaagctgtttatggaaattccactcgagcactggggcaggctgactttgatgctttcatgcaggcccagggtttacctatcttccggacttatgatcaaaaatatacccagatcggaaaagatggcaaaattacgaagagccggtacttcccagaaaatcgactagttttgatgaacgatgatcccattggtaacaaggtatttggcccaactccggaagaattggcacagtttagtggggctgcacaaattaattccgtgggtaacgtgtatgacatgatctacacaaactctatggatccaattggtacttgggaaaaggcttctgcggttgctttaccatcatttgccgctgcggatgaagtattccaagcccaggttttagcctagaggtgattgataatgaaggttcgcgttaaaaatttcccggttcggtataaggatactcgatatgaaaaaggtgatgagctcaacattgcgcaagacgcgttcaatgatgagctttttgtttgtcttgataagcagaaggatgagaaaaccaccgataatgctgagtcagaaactgaagacgaagaatagggggtgacaatatggctaagccaagcccaccggataaggcgggacaattgataaaactgtatgcgcgactgggtgttaagaaagatacgccggatgctgcaatgattgatgatatcttcggcgatgctgttcaaacgtgcttggattatacccggtctacgctctcaacaccgattctaattcaggcaaaacgtcttgccattatcatgtacaacgagcaagggacagaaggtgaagcatctcgttcagagggcggtgtctctcaatcgtttgagctgggactacctaacataattaaaactgcattagcgccctatcgtgttgcgaaaacgaggcgattctaatgcgtcttaggctaacgggtctcacgactgtttatttgagacagaagcagaccggtaaagatgatgaaggcaatgtcattacggcgggatggagtactcctatagcggtaaaaatgaatattcaagctgcaggcggtgctgttaatgcgcagctttggggcaaggaactcaagtacatcaagtctggcaagtatcagggtgatgacatcaatgagggtcagcaagagaattggggcgtctgcgtcaatgttgataaggatgatgaacctgattacgttataaattcaattcaaacatttagtacgcacaagaatatcactttggagcaatgcaatcgagatgatgggtctaatgactgagattgaatggaaaggctatgacaaattgaaggcacagcttggcaaacttcctgaggtagtgcacgacgctgtttgggatgctacgttcgatgttgttgaaaaggctgagggttatgctgtcaaagagctacaatccagtgttaaatatggcaatggtgagctagcccgtagcattaaatatgaggtcgttaacaaagatggcgagattgttggtcgcgtttggtctaatgatccagtagcactgttccgtgaacttggtactggtcgagttggtgaagagtccgagaaagacttgcctgatggctttactcccatgtataggcaaacaccgtggtttattccagcagatgacgttgatacagatctcaatgaattgtacggaatgcccaaagttgaaattaatggtcggcaattttatcgcacgaacgggcaaccagcccggcaattcatgacaccagctgttaaacaagctagtcaagaagctccagaaataattaagaccagtgtggagacggctctgcatcacaagttagggggcagttgatggtaatcgttaatgttaagtcattagtctatcaatcgttaatggctataccagaaattaagcaggtatcaactacttatccagacagcctgactgtgttcccaacagctgtttacaacacgtcacataaggcctattttcgtgacgcggatcagcaagaattgcagacagcatggactattacgattgatctgtttttaaaagaaggaagtacgacaattattacgaataagctcatgtcatcgtttggtgatatgggcttttctagtgatgttggtgatagcaatttagcgggcgtgaatcgcactgtactgcgattcactggtgtagttgataacgtgagtcaccgcgtatttgaaagttgaaaggatgattgaaattgaaaaagaagttaactgtatttgatttacaacgatttgcagcagacgctagtgccgggcttgccggaactgggactaaattagaaatgtcaacagatgggactaagttcgaagaaattggcggtgttaagacaattcctgacatgggttcagatccagaaaatattgatgtgactgatttgtcagatacgaaaaagaagtcggtgcctgggattgaaaatacgtcaacgcttgcattcacctttgtgtataagggggctaacttcgcgacggccttaacgcacaatggtgacaacaagcaatataagtggcaggtaacttatccagatggtatgaccgctactttcactggctcatatacagtcaagatgggtaacgttgccgtcaacggtgcgcttgaatacacgatttcaattatcgtgtcagacgggccagattttgcaatggccagtagtggcgccggagcatagaacaattatattttatccagatagtaaataacttgagtaagagacgagtaagccagctggctgatatgagacgaataataaaaatggaggaattacgttatgacagtaaaaaaagcaactaataagtttgaaatgggtggattacaacttgaattgaagttaacaggccgggatattttgaacattgaaaaacgtttaggtaagtcgatgatgtcactgtttatgagtgcggacggcggaatgaaattgccgccattaaatgaaatgctaattgtgttacaaggagcgaaccaaactcacggagttactgataacgacatttttgctgcctttgaaaaatattttgatgaaggccatgccccaatggatttatttacagtgttaacagacttattccaagaatcaggttttttcggcaagacagcttcggtttcgaagacgaatacggaattggaggtaactctggacaacgaaccggcaacagagacgacactctaaacaataactatcggacgatttccgagttattacttgctatttatccgttagccgtacaatcagggattgattctgatcgcttttgggagcttgattttggtgagttgatggtgcaaataattgcgaacaatcgtaaccgtatgggtgatatgcggatgagagcagtaatggaccataagcaggctgagatgatggcgtttgccttgaatgaccctagcaaaatgccatcggttgaagaggcatatccatttattaaaacggtgactaaatcggtagcagagccagaatggaagcaggatcaattactgttaatgcaacagtcgcaaaagattaagacagcccgaaaattcaaaaaaactacataggaagggggaaacaacgtggaacttgaagaaattgaaatgctatttaaagtgaacaccgaacaaatggaagaacagtttgccaaggttcaaccgatgattgataaattgatggggaagaccgctgatagtgcgaagtccggtatggacaagaccgagcagtcgatggatgtttctaaaggtgttcaaaagttgcaagaccagttgtccggtttgaacgagactatcaaaactgcattcgaacgaatgagtagctcgacatctaccggggctaataaggtcagtcaatctgctggcaagatgtttactggtagtcgctccaaggttaagcaagacttgcaggctatggtaagtgaaatcaatgccaagatggaccaggcccgagctactcaagccaagatgcgtgacctaatgaatcaaaaaacgtccttgaataccgctcaacagaatgggacgcaaggaattaaaattgataatcaggttgcgtctgctcaagctcagatgacgcgttatcaaaaccaagctaaagccctagcccaatcaatgcgacaagaatttaaagcggtgccagattcactacggcagatttctaaagctatggatcaaaacgaagttaaaattgaaacctatcggcgtcagttgaaggcgttgcagggctcctatcgtgatgttcaggattctatgaagacgatgggtgccagcgaccggctgaccaagcaaagtacggcacttgaaaagagcatcatgagcacacgcgataagatgaacaagctcattaattccaatgatagcctgaacaagagctatgcttatgtttctgatcgtggtgaagaacttaaatctgtaattggtaagctcaatactgagatgggtgaatccgggacggctgctacacgagcggcaggttcgtataatcgtttcggtagtgcggcaagtagcgcaatgaataaagcatcaggttccggtaaggggccttctaattggttcagtcgcattagcaacggtattcaaggtgcaacaagccggatacgcaattttggaaatagtagtagttcttcaatgaacaaagcctcttctagtgctaggcggaccagcggggcactgggcggcattgtccagcagttgaagtacctcccatcacaattaatcgtatttgggttgctgtaccaaggcttgacgcaacttgctactgggatgatgacagcatttaagacgaacgcgcagtttgcaagtagtctgaatcaaatcaaggtcaatttactgacagcattctatccgatttataactttgttcttccggctgtgaatgcgttaatgtcatcattatctaaagccacatcatggttggcacagttcacatcagcactaacgggtatgagttactctaaagcccgacaaggtgcacaggggctttatgagcagtctaaggcacttaatgatacggcctccgcttctagtaaagcatctgcgtctgttaagaaagctaatgaagaaattcgaaaacaaaatgctgcccaggcaaagtcggttcgtgaggctaatgcacaaatacgcgctcaaaatcaagctcaagcagcctcagttcgtgaagcaaatcgacaaattgctgagtctaacaaacaaggtgcggccaaggttcgtgctgctaatgcagcaattgaggctgcaaataaacggtcccaggcctcaatggaagcaaccaagaaaaagaataaagagctcatgcaatctttgatgggatttgatgaactgaatgttcttgataagagtaatgatgctgaagactactcttacgataaaaagcctaaagagacttttactccacaggaaacacaaacggcaccagactcaacaccaacacaaaacgcaccggaaagtacgccactgcaatcgacggatggtactgatgctggtgatgatggtgtcaatttcggcgtaccattaggtcattcattcaacagcgcaactgatgcagctaaaaaactgcaaaaaattttaggtgagctgttcgacccaatgaaggcagcttgggatgccaagggtaagtcagtagtgaatgctgctaaatatgcttgggaagaggttgaacgagcgctcagcgatgttgggcgctcgtttatgcatgtatgggataacggtactggtcagaaaacagtagaagctatcttacaattgttagcagacatgcttaatattattggcgatattgccaaagctttctcacaagcatgggaaggtggcggcggtcgtggtactaagctagtccaaaccatttttaattcgctaaataatgtattgaaactgatacatgatattgccacttcattccgtagtgcatggaatggcggcaatctgggcgaacggatttttgccaatctcattacgctggtgacaaatttagtcgggctgattggtgatatcgctaaggcgtttgataatgcatggaatcatgggagcactggtaccaagcttattcaatcaattttaaatgcattgaacgctgtaacaaaagtgcttaataatattgcagtagcatttcgtaatgcttggaatagtggtgcgggtgagaagattgcatcaaatctctacaagatattcacaaatatctttaatactattagtgcacttggcggtcaatttgataaggcttggcaacatggtggcgttggtacatctatttttaaaacgctgctcggtatggttaatgacatgttgggtgcgttaaatgacatggcaggagcaacagttaagtgggcttctaaacttgattttacgtccttactgcaatcgattgatagattactaaaagcgattagaccagtagtcaaagacgtatggaatggtttggattggggatatcagaatatcctgttaccattggccaaatacacgattactaatttaatcccaacgttcttcgatacattagctgcggcgcttaagttagctcacagtattattcaagcttcacagccagcctttaaatggatatgggattcgttccttaagccattagcaaagtggactggtggagttatcgttggcgtgcttaagaagttagcagatgcattaggtgggatttccagttgggtagataaacaccatacagccgttgaagcaatggcgaaagtcttagtaactatgtttgcgtttaaagtaacaatgacggggctaagcaatggaataggactacttggaaaattagctgataaagcggctattattggtggtaaagggcatgttctcagagacttttttaaagggattactggaattgataagctagaagaagctgttggcagcgtgaagacattatggtcgcttgcaaaaatgaagtggtcagattatgctactgcattagcagatggttggaaggcgctcaagagttggtctgtgtggtctaaactagccgctgttggtcaagctgcattgaatgtagttatggacgcgaatccagtagcattagtggtattggctatcgctgcattagttgctggattcgtcgcgctatacaaacataataagaaatttagagatttttgtaattctgtttggaaaaatataaccaaatggtttggagattcaatcgattggatctctaaaaattggactaaaataattggttttattattaatccggttggcacgattgcttcctggttccttaaagacacaaaaacaggtaagaatattcttaaatgggcatcgaaattaccgggtaaagcctccgattgggctaagggtgttggtaaaaaggttgggaccaatataactaatgctaagaaagatttacaaaaagcaggaaagaatattggtgattggactactggatttattggcggtgctaagaaaaccattaatacttgggcatcgaatattggcaacggtgttcataagaaagttgaagatggtaaaaagttagctcaaaaagctggtaaaaaaatcggttcatggacttctgaatttactgacaaaacgcacggtgcaattgttggtattcgaaagtgggcatcgaatattggtagtaatgttaatactaaaattgaagacggcaaacgattagccaaaaatgcaggtagtaagttaggttcatgggttaataactttagatctggcgcaagtgagactatatctaattgggctggaaaattaggatcgaaagctaattctggaatgggaaatgctagaacggctgcgttaagagccggtagtaagttaggtgattgggtcgcctcgtttagaactggcacgggtaaaacaattgcaaaatgggccggtggtttaggcggcaaaattggtggcggtctttcatctggttggaggtctgtaaaaaagggttctgcggatgttgctaatgcaataatcggaacgattggaaaagctgttaatggtgttattgatggtattaaatggatcctcaatcacgtaggcgcctccagcaaagcaaagtcattaagccactggagtgttccttcatttgcaactggtggtcgccataaaggtggtccagcaatcgttaatgatcaggttggcgataagtatcgtgaagcatacaagttaccaaatggacgaacaggtattttcccagcagttcgcaatatgatggtcaatcttccgagaggtactcaaattctcaatgcggcacaaacggctcgtaaagcaacagcaatggtgccgcactatgccggtggtattggagactttgattttgacttttcaagtctaagcaaaataagcatacctgactttcactttgatatgccagatttcagtcatttgtttgatggtataggggacagtgtaggcagttttgttgatggtgtgaaagacacggcaagtgatatttgggatgatattacacaccctgaaaaggtattgaaagcagccatgaacaagtttgttaaatttaccggcttgggtggttatccgcttgatgttgctaaaagtatggtggattttagtgttgatagcgctaaaagttgggtcggtaagatcctcaaacagtacggcgagagcgaagggccaaatggtggtgccatcacgcattcaatgatcgcccgagcattagaaatgaccaaagttcctaaatcgcggtggtcaaagatgcaacacgatatcattgaagtagctaagtcagaaactggaaatcgaaatattatgcagacaattactgatgtgaactcgctagctggtaatcctgccggtgggccattacagtatgtcaagtcaacatttgatgcgtttgcttttcctggacatcataactttagatcatcatttgaccaagtattggcttatctgaataactcagactattacaatgctgctggtcatacagtcatttggggcacgcctaaatttgattggttgcacagtggaccgattgggcaccgccgttttgctaatggtggtcttgttgatgctcatcaaatgatcgaagtggctgaacagaataagccggaaatggttttacctttaactaacattccacggtcagtgcaattgattaagcaggcactaagctttatgggacagacgttcagtgatggcctacaaatgcccacagctttaactcagtcgatagatatgagcaacctggctagtcagccaagtagtacaagtacacagagtatgaatagcggtggcattaacgagcttggaacaagcattgttaacgcgcttgtacagggcttacaaatgacaaacgttggtggcagcatgaataaccaaccaatcaatgttaacttgacattgcaagttggcgatgagaagttcggcaatgctgctattaaaggcattaacgcggtaaatcagaagaatggtaaaaacatgttgagactataggagatgattacgattgacgtattcactgaaaattggtgggacagtggttaaagcgccacagtccttagaagttgcaatccaagatattgatgcaaaagcatcgcgtgacgctaacgggctactgcatcgagatcgggttgcaattaaacggaaattaacagtaaaatgggggccgctaacactggccgaaaatagcacaatactaaaagctgtctctggacagtttttttcttgcagttatttagacccacaagaaggtgcagtagtgaccaaaacattttatgttggtgatcggactgcgccgatttatacacttaatccagcaacatcagattatatttggcagaatgtttcaatgaacttcattgaacagtaggagggtgaaaattaatgattaaacaatctgatttagcccttgctgcatggaaggcaactgaacggacgttggatgcagttgtcacaattaacaagattgattataaaacgacggatattacatccatttcgtatgacgctggtggctataccggagatacgtttggtatcggttcgaattatgaaaacagcgtgacgattaagttttcgcacttaattgaagggcttaaacctggcatgacggtaatgcctaagattggtataaaaacatctaatggctacgagtatagcccgcttggtctttttatcgtatcagatgacattcaaatggatcgaaacaacgatgagacaacaattcaggcatatgatcagatgtgtctattggagggggcctacacttctaagttaaattaccctgcgaaaatgaccagtgtgattgcagaaattgcaaatttggctggcgtgtcacttaatacaactgacattagccgtttgcctgtacaaggtgacttaccgagtgctattaccggtcaaacgtatcgaaatgcaattggtatgattgctcaattttatgctggatttgcaacgtttgatagagacggcaaattaacaattcgcacgattgcagagccagattacacattagatccgagccaatacgaacaaggtggcttaacaaaaaatgaagcaccatacaaaattggcggtattcagtgtgaggtcacaacgactactacggattcaacaggtcagagtaccgaaactacaaacacgcttcaagtaggggcaacgtcaggatcacagattaaactcaccaacaatttgatgacaatggatcgtttagcatcaatatggcaacagttacaaagcttgaccttctaccctttcagtttgaattggtttggcaatcctgcaatagaagctggcgattggctaacactacaggatactaaaggcaacaagttcaacgtgcctaataatgtttatactatgacgtttgatggcagtttgtctgctgtttctaaagcagatcagacctcaacctctagtagtagctatgcttggcgaggcgagctatcacaatatgttactgacttaggtggacgacaaggtgcttcgggtaactatatctatggtacagatacaattgaaccgccatacggagctaaatttaacgatatctggtacaagcagaacggtaataaagttgaattgtggacttacgagcgtcaggcagatggaactggtaaatgggtacttactgtgtcagacgctactggggaagaagtgaaagcaaaagttgaccaagtggaactggaagctaaggctagtatagatgcagctaaagcggccattgataaagctgcccagcttgcggctaagtacgatgatacaaatgcattagctaatcaagctatggataaagcagtaggtgcacaaagcgacgctagttccgcagctgctaaagcaaactctacagcctcggaattcggaaaagttgaccaaaaggcagagagtgccttagctagtgcacttggcgctcaaagtgatgctagtgttgccgttaaacaggcctcttctgctgcagctgattctaaagatgccaagcaaatagccggagcggtcagccagagttacaagactctaactgatggttcaactatgaccattgcagagttagagaatggtctagctacaaaactgactaagactgatttggatggttacgctactgagacttggacgcaaaaccagattaaagttactgctgatggaataaatgcgaccctgtccagtgtcaaaacgactgttgacggtcagactatcagtattaatgacctcaaggctgactcaagttcttttaagagccagtttacgactgttaataatactctgggtaagcacactactgatattggttctttacaaacgacgtccaaggaattgactactgggtttaatacgttaacgactgataatggtactaataagaacgacattagccagttgaaacagacttccacagaagtcagcagcaccttagaaactgttaaaacgcaggttcaagatagttcagttgggactaacttgtacactgatactcgtgactttgaaaatcctgatgtatggaacggctggaacaatgcttataaaactaccgaaaagtttaacggtttaactgtaatgggaaccgatactgattggggcggtttaggtcagactatacaggccaagaaaggcgaaacttataccttctcagtttatgcaagatataaaagtggaactggcaattctaaaatatattttagaattagtaatgattcgaccaacacggatattggagcagcatcagtttctttgaacgaaacatggcagaggttcacagggaccgcaacagtaaccgctgatggacaaataaatgcacgtatcgaacgaaccgctgacaatactaataccttgcttattgccggacctaagcttgaacgagggtcaatgatgactgactattcagtaagccccttggataatgctacagttactgctttctccaagctttctcaaactgtggatggtattaaaaccgatatctccaagaagattgagcagaaggatcttaatgggtatgccactcagacatggactcagaatcaaattaaaataacttctgataaccttagtgcaactttgtcaagcgttaaaagtaccgtcgatggtcatgcaaccagcattaatagcctccaagctgactcgagagggtttaaagaccagtttacgactgtcactgatactctaagtaagcacactaccgatatcggtacactccagtcaaccactaagtctttatctgctagctttgattccttgagcactgataattccaccaataagcacgatattagtcagttgaaattaacggctaaatcgttcagtagcactttggtcactgtccaggaacaggtgaataatagtgcggttgggaccaatttactgatagggactacaactcctgtgtctatcaagggtaataattctagtaatcaagctgggaatacctacgctctagttgggggtatgagtgcttatgccttgtatcaaaaatacgggagtacgtttaccttaagctatgattggtctgttacagatacagctagtgcttacacagggcagatgcaacaacagtttaatcagggcccttggggctttaatgatagtactatgatttcaagcagtaacaaatcagggcataaagttactactttcactctagcaaacaactctgccaatacagctactggccttcaatttagactagataatgtgccaaccacgtcaacaattacagtgtctaatatgaagcttgaaaaaggaaatgtagcaactgattggtgccctaatccgttggataatgcaactgttgactcagtttctagtatctcgcaaactattgacgccattcaaacaactgttcgtggaaaagtagacaatgacatttaccagtctaaagtaactcaattgaataatcagataacctctgtggtaggacaagtcaatacttttggcaagcggaatatggtcactaatgcacagttccagtatgactatatggatggaacctcttggaccggtgggacaaccacaacttggtataagtcagattttgcttgggcatgggttaacggataccaaggtatttgtactaatcagccattatcaacaaacgacagtacttggtctgccttgcactcaagaagaattgttattggacaagacctctcaactccctggtcagctagtgcttatgtgaatattgataccgttggaatcgatgcaaggatcactgtggaattttacaacactagtggtgctcgtattggactcaaggaaacgactaaaaaaagccgtggactagaactaattaaagttgaaagcgctgttcctccggctggaactgaaactgtttgtcttgcacttcagattcatggcggtgggcatattgctatgatctgtccaatgcttaaccaaggagatactgctgctgcctttactcctgatatttcatctaatgcagaccttgagcacgcatattcctatatcaatcaagctaatgataggatcaattttcgtgtcgaaaaggcgggagttattaacgcaattaatatctctactgaaggaattcagatatacggtagcaaattgcatataaccgctgatacctatatcgataatgccgtcattaaggatgccatgatagcgaacctaagtgctaataagcttactgcaggtactattaatgctgcgaatataaacgtaattaatttgaatgcgaacaacataaccactggtacgattaaaggtagtaatttatcaattaatctgaatactggtaatgttgaattccaggcgggacgtatccattcgactgataatgcaattgatattaacatcaataataagtatatttcagttgcggataagtataatcgtgtatttatatctggcggggaaattcaaatgatccaaccgacactattctcaagtcaatctagcccgtatgttcgtatcagtaacgctcaggcaggggcatcttggggtggtgcaactttctggggacgtgactattttgtggttactaacggagctaatgatggcgatatatttacgtcaccaatgggtgaagaaaggttcgcaggtatttctggaggtcattcaaccagcggatggcaagtaaccaagattggtggtgcagaacgaggtgtatgtatatctggtggtaaagcattcactgatggcataagcttttcaccgtttataagagttggcgatacgggtcatgcaggtacaggcatgaatggttctaatatcactatgcatgccgattatatttatctaaaaactccccatacatcgtcccatggggcgaatgcttatttggccactgatggcgcattagttatgtcgacttccgccgctaagtacaagactgacatcgttcgatcatttgaaaccaagatgggggacaaactcctagaaattccagttgcacattggaaagacaaagaagaagtattagcaaagactctcgatcctaacgctaaaaatccagaaacttatttcggaatgattgccgatgatctggatgctgctggtttgaatgaacttgttgagtacgatgataaagggaatgtcaatggtattcagtatgatcgggtagcattatcgcttattccgttaattcgcaattatcgggaccgcataactgaattagaaaacaaagtcaaacaaacgaaagaggcataattaattatgacagcaagcaaagaagtattaacattcacaaatggacaactggtagcaattggaaatactttatcagagttcaagcttaaaggtcgagcttctcttgggcggacgtggctaattaagcatcttgaggatctaaacaagcaattcaacgctgaccaattagcaacgcaaaagaacttttttaaaactgataaagatggtgattttatctataagaaagacaaaaagactctaattctgaaagatggatacaccatggacgaagctcaaaaagagtttgatcaattggtagacgaaccggtaagtattgaaattagctcatattctgcacgaatgaaagctttatttcatgcacttgaggactatccatatgagctggaagggcaaacagctctagtatacgcattagtatttgatcagtttgataaagcatatggaaaaggggaataatgatggaattattaaacactagcatctcttataatatagatggaaacggtaacacaacttccgtaattgcaggtcttcgtggcgaagtagaaggtcgagcaactatcacagcaaatatcactatttatccgacagacttaactaaagatgaaactttcgatgatctaacaaaaaaagaattatctaaacgtgcggtggataagattccatcagtaattgactctctaattgcagttaatggtgggtggagttttactgctggcaagatttcatcggtatccactcaatttaatcagtctgaaactggcacatatgtgaatgcgaatgttactgccactgaatcagatttttcagataagaagttagacgatgttacgatgtcggaggcgcagagtgtgctgcaatccattcttaagaatgaattgccaacatcataagtattaagtgaaagatgaactttgaagagatggtgaattgaaaattaataagttaaaacgactaggcaagtgtattttaggacgcttttgaccgttcaatcaggaatgacaaataggaggtagacaattgaataagcacaagttaaaggcactcatcttaacggtgggcgccatttttatggcctttttaatggtcaatgttaccagtcaggctgctcgcatggacatggtcgatgtgtcgaataacaacggctacatgagcaccgctgagtacacatccatgcgtaacgagttcggtgttaaggccctcaccgttaagattagtgaaggcacaaccttcaaagatggctatgctgctagcaatatcgctaatggtcaaacggctggcttatacgtcaacggctatcattttgcccattataagactagggctcaagcgattgccgaagcagactttgctggtcaggcagccaaagcagcagggctaccggtgggtgcagtactggcaacggacgtagaatcggctgaagaacaaggaatcttatcccaagcgaccaatgaccgcaacaatgccgccttcatgcgagagattcagaagtttggttatcgggccgacatttatacgtctggatcatgggctaacaacaagatgaccatcaagggcaaaacaggttgggttgctggttacccctatgtcatgtctggtcagaaatggtatacgaataataatgcctggcaatggtccgggtcagctcgttttcggattagttacggtggctttgacgtcagtcagctttatactgattactacacagctggtcaaaaatcaacggtcaaaccgaccgataaggatgcggttaaggccaacaaccaggaagccaaaaaaaacacttctaagccgtctacgtcagccaagtgggtcaaggagtcaaaaatctacacgctcaagactgcggttaagctacgcattggcgcctcgacttcatcaagtgttatcactaccttaccagcaggcactacggtaaaaactgatcaagctattattcaaggtggttatcgttgggctcgtcagccacgatttaatggttatggttatctagcaacaggcccagcaagcaatacgctggaatacgtaaatagtggtgccactcacatgtactacacagtcaagtctggcgacagctggtggtcaatcgctcagcgaaacggcctaagtatgactacattagctagtcagaacggcaagacgatttacaccactatctatcctggccagcgattggtggtgcggtaattgcatacactattaggattaggctgggatgaatggggatcgattgttgccattgtcactagtgtttgtgtgttagctaactggattttaaataaaacggtccgcatcccacttaacgatttaggaaagcggcttagccggtttaccaatgaaagcttaaaagtacgacagcaaaacgccgacgcgatgaacgcgattgaaaatcgggtcattaaggtagaaggccggttagatggtcatgacattgaatttaaacatctatatgaaaaggaagccaaaggaaatgaaaaaaattagttttaagaatgccgacggaagtttaaatggtaagttgattgctgggattatttcgttactgatcgttttgattcaacaaatctttgccatgtttggcattaagtttactggtgactggtcagccattgtcgccgttattaatactgtattaacgatcctcgggatgctgggtgttattactgacgttcaaacggtggcagcgccaacagttgatagtaatgagaaaatccaagtcgaagcaacgactaataaggttgctgatgaagtgcaagggccggcgtccacagctgctgtagcggatagttctgcatcatctgacgctgaaaagtcgtcagaatccgcctcacaagcaggtaaatagtagtataattaaatattgaatttgctaatcccctgcgtttcggcgcaggggattttttgcgtaaaaagccgcctgctgtaaaggcagacggctaatacataagaaaaaggatcttagcgaaagaggaaaccagattattactaggttccattattatcataggaatatatgagaaatcgtgcaactttaatactcactactgagaaacactacactactggtaattggtaagtggtattctaaatccatagcttctcacaggtaccacacggtcaagtccggtgatagttggtggtcgattgcctaacgcaacggcttaagcatgtacacactggctagccagaatggtaagagtatctattcaacgatttatcccggtaaatcattacttattaagtaatgatttagaaaatcagtcaaaagatgtaaaaccggaaaaatgaagcaagtagatgcaatgttaatacattgccttttttggtgaaaaatgtaaacacctattaggaatgttagtaatatggtacaaattgatttttaaccacaaaagttgtaattttagacaaaacaagaaaaactcacactggccttaattggctggtgtgggacttttttgtgtttaagataataagttggtatataataatggagaaagcaaaacatcaaaaaaggatcaatattaaattaatttgtgttcttccacgatttgtaaataaaatatctctctttttcgcaaagggcttaatatcaatggtttgttacgtgctacctatgatggtataactaccgtgcgggtgataagtcgacgtcggtagataaaaagagaagcgtcataatgctggtatatcagcattatgacgcttctcttttgctaattggtatcaaattaaaaccccaattttgcgttttggctgttgtgatcacaacagcactgttaagcgctcataaaaaagggttttgggatcgtgtcacaagtaagggtcctatgaattaattattactcgttaatagtgtctgaaaggccgttagcgacattccaggtacgacccgttgtcgagtgagattgtatgggttctgtgtgctggtggcgatgccaggtgccgttgatagggcatactgatagccagcctgtttatcggctttaatggtctgctgattagcacggccggctgggtaacaaataacttgtgtgttctgttgtaaattatgatcgagccattttttggaacttgataattccgtaagttgaacctggtaagttaaattatttaaatccagatggcgaacggtgtgactttgaaaatcaatattaccggatgcttgcatccgattagcatcagctaaagttaagtggtttttcttatgggtaaagccggtaataaaattaatggtggcgtgttggtgcgtctgtttcaaaattggccaagctgctgtcatgttatctttatagctatcgtcgagtgtgatccagacaatcttcttttgtggaattcgccgatgtttgagcgcgtatacggcttcattggcagtcagcgttcggtagccgtgtgcctttagataagtcatttcagtttgaaattctttggcggggacacgtaactggttcccgctagaaatactgtgatacatcaaaataggcaagtgaacatctttgacggtatgccaatgttgataaggccgtgcttgtgcttggtgtttagccgagctgtgaacgcttttagcgctagtcttagatgattgactgctggcttgtttagttgccggtgaagccgcctgacagcctgctaacaggccgagcgcgacgccgagacctaatacaaagttgataccccgcatgtgcatgataaatccccccatgatttaaaaactacttcctattctaatagaatagcatgcaaagcgcgataattattgaattattgttaaaataatttccttaatgtttaaggaaaatcgaatttgattagtaatcgtttaaactgattaagaaagcctagttagggtagccagaggagctttactccgatacgattaataaaataattaattcgggggatagtatttatgaataaaaaaagggctatttggttggcggcgattattatgatgattagtgtaggtacattgttaattgtaccgacgatgacgaagaatcaggggagtgagctggcaatggcggtggataacttaaacccatttgttaaggtacaaacggtctatggtcggactaatcaggcaatcggccactcgactggtcagatgggcgaagatatctatacctatcgaatgctgaccagcgatgcgcaaggtaagcaacgctggttgacatttaccgcagatcaccggctaaagcaacgacactatttaaagattgagacgaagggacaaaacgtgaattcatgggaggccgttgcgacaaatcaggtacctcaaaatatacaagaagtattggcttaaatttaggcatagtgccgtgtcagcgattagtgacgcagcactttttttgtgttattacgaaggcgagcttaataaattcttaaatccttttgagtgctaaactgcgatgagtgcgttacaatattttacgtgagacttgtaaagatggttgacaaaaggaccatttttagttagattaagatactgcattattatgtaataatgaatgaaggggagcgtgcaaatgcttaaaatagcaaagggtcggatttcgtatcccgcggtaatcggtgcggtcttatttatgatcgtgcaagtgattgcgaccttaaatctgcctagtttgacatctaatattgtgaataacggggtggctactggtgacattagttatatctggaaaatcggatttgaaatgattggtttttcattgttatcagtcgtcgcagcgtttggcaacgtctttttggcggcgcggtcatcacaacaattagggaagaatttacggtcggatatttataagaaggtcatcaacttttcaaatgatgaatttgataaagttgagacgtcttcactaatcactcgaacgaccaatgacgtcgtccagattcaaaacgtggccatgatggcgttacgaatgatgattatggcgccaatcatgctgattggtgcaagctttttagcgtataccaagagtcatgaattaacttggatcttcgtggtttctattccggtactattgatttttattggtttgatcatggcgtttgcaataccgttgtttcgggcgatgcaaactaagactgaccgcatcaaccttgtttttcgtgaaggcttaacgggagtacgtgttattcgagcattccgtcaagataaatttgaacaggaccgttttgaagacgctaaccaagattacacgcacaatgcgattaaggttaatacgattgtggccttggcttatccggtaatgactttgattatgagtgggactaatgtggcaattgtctggtttggtggccaattgattagtagtcaaacaatgcaagttgggaacatgattgcgtttatgacttatgccatgcaagtattgatgagtttcatgatgcttgccatggtatttgcgttcatcccacgggcggccgcttccgcttcccggattcaagaagtcttgagtattgaacctaaaattactgaccctgacaaggcagcaacgttaccagcgacgactgaacacagcttagaatttgatcatgtcaactatcggtatcaaagtgcggagcaattagcgctggcagatattgactttaaagcccattctggacagaccgttgccattattggtgggaccggttctgggaagaccacgctcgttaatttaatccctcgattctatgatattgagagtggggcggtcaaattagatgggaaagatgttcggcagttgaagttagctgatttacatcaagccgtttcgtttgtcccgcaaactgctactttattcacggggacgattcgtgaaaatatgcaattcggtaacgaacacgcgaccgatgatgaaatctggcatgcgttagaaattgctcgttcaactgacttcgttaaagaagaaggcggcctggatgcacacgttgaacaaggtgggggtaacttctctggtggtcaacggcaacgattagcaattgctcgtgcacttgtcaaacaggcttccgcttatgtatttgatgattctttctccgcattggacttcaagactgatgctcaattacgggctgaattacgccaggataaacagattcaacagagtgtcgtagttatcgtggcgcaacgaattgcgacggtggcggatgctgatctgatcttggtcctagataacggtaagttagtcggcaaggggacccacgctgaattgaaagctaataatgaagtttatcaagaaattatgaagtcacaattacgagaggaggatcagctgtaatgagcgaaaagaatacgagttctactaagcctgcacgtcctgctggcggtcatggccccggtggtcatgctggactagttgaaaagcctaagagtttttggaaaacggcgattcgattgatgcgctacatgtcagaccggtgggtcggtttggcagtggtcatgatttttgccattgcttccgtgattttccagattcgaacacctaagattttaggtaaagcaacgaccgaactttataagggaattatgaagggggccgcgcaacagaaggctggtatcagtcaatccggttacccaatcaactttgaaaaaatcggtcagattattatgatcgttttgatcatgtacttggcctcagcactgttcaactttattcaacagtacattatgacgcggatttcccaacggaccgtgtataagttgcggcgttcatttaagggtaagatgcaaaaggtgccgatttcatattatgatacccattcgaatggggacattatgagtcgggccgtcaatgatatggataatattgccaacacgttgcagcaaaacctaacccaagcggtgacaagtaccgtcacctttgttggaaccttatggatgatgctgacgattagttggaagctgaccttgattgcactcgttaccattccactgagtgtcgtggtggttggtgtgattgcgccgaaatcacagaaattcttcggaacacagcaaaagagcttggggttgttgaataaccaagttgaagaaaactatgctggacacgtggtcatcaagagctttaacaaggaacaagatgccatcgatgattttgaaatccaaaacaataattattatcaatcagcctggaaagcgcaatttatttcaggtattatcatgccactgatgatgttcttaaataatattggctacgtctttgttgccatcattggtgggattgatgtggctaacgggaacgtttcgttaggtaacattcaagcgttcttacaatacacgcaacaattttcacaaccgatttcacaaatggcgaacttgttgaacacgattcaatcgaccgtggcttccgctgaacgggtctttgaagtgcttgatgaagaagaaatgaaacagacgaaatccaacttaccagccgaaccagatagtgataacttgattagtctgcaacacgttcaatttggttatgcggataacgacctgttaatgaaggattataatctggacgttaaacgtgggcaacaagtggccatcgttgggccaactggtgctggtaagacgaccatcattaatttgttggaacgtttttatgacatcaaaggtggttctattaaattgaaagggaccgatacacgggacctggatcgtgaagacttgcggtcacactttgcgatggtgcttcaagatacctggctctttactgggacgatttttgacaacttgaagtacggccgtgaagatgcgtcagatgaagagatttatgctgcggctaaagcggcccatgttgatagctttgttcgcaaattgccagatggttatcagacggttctgaacgaagaagcttcaaatatttcacagggacaacgccaattattgacgattgcccgggcgtttgtggctaatccagaaattctgattttggatgaagcaacgagttcggttgatacgcggactgaagtgcatattcagcatgccatggaacgactcctgaagaaccggaccagttttgtggttgcgcaccggttatcaacgattcagggtgcggacaacattattgtgatgaaccatgggtcagtggttgaaactgggacgcatgaacagttgatggctcaaaatgggttctatgcggatctatataacagtcaatttactggcaatattagtctcgactaaaggaggggtgtcaattgttccggaaaacagcaatggttgccgttactgcgggtgcgctaacgttcttattagcgggctgtggtaagacaaccttatcaacgactaaaaccacatacaagccgaacgggttagtagcggccgtcaaaggaaaatccaacgttaaaaaggttcattatcagcttgacggtggtcagacgaagacggcgacggtgcgtaatcatacgtttgttattcaagttccgaccaagacgacccgccaaacggtgaagattaaggccggttcggataccacgacggtgcacgtaaagggcgccaagaagctagttggctatcaaaagatggcgacgacttacaatcaggctttgattgcttctaaactcagcaagtctgatcaacaggcggctaagaagttgcaaactgagggtgcagcccttaaaaagcaacaagcaacgatccaagccaaagtcaagcaagcccaggcccaaatcaaggctggcggtacggcggctgccacgggtgctaagacactccaagcccaacaaactgctgcggcgcaactcaagaccaaagcagctagtttgcaaacgactcagaagcaggtcgaagcggcaatggcaacggcgaaaaagcaggtcaagtcgcaattgttaccgacgaagacgccaagtgatggcatcacgaacgtgttaacaactaaggattataagatccggctaaatgttcagaagggtgacgtattaggggcagcaatgattgttccaaccaaggcctttaagaacaagacccgccagaagaactttgggacggcgtttgctttgatgacgacaacaacgggcgccaatgccaagaaggttatgaaacagttccagaaggaaaccaaggataatagtggtagtacgacgacaatcgatccgattacctctaagggcgttcgcttcacgattggtgtctccacgtctgacttgtatatctttatgactaagtaatgttttatgagcgcgactggactttgattagtcaagtaaagctcactattcgaggttatgacgggacgaacccgtagttctaagtcggctgcattttacgcttgtaaagtaatcaaaaaatcaccacctggatgaacataatccaggtggtgattttttgattgatccattttaaatttgattccaaatagaccgtaaaggttacgtgcgttaaattactcaaatgataactctaagaagtataagtgtttggctggtaaatgggccgaagaaacccacacttcatggtagttagggacttttttctctgtgtaatcgaagaagaaatcaagtaagttgccgtttttagcgacaaagtcatcctgaaatcggttgactaatagcttgttgtcaggaaaataaatttcggggttagcgaccttaatatgatcggggacacccatccgaacgacattcgtgtattccggttgggtaaactgaatttcagtcgggtgatgggtgatatagaacatgacgttataaattgaatctgaattactagccacgacaaaccagtcctttgctaaatttacactcattataccaaaaaaatcttaaagcgttggaaatgtttgacgggcccttgacaaacttctaattaaccattaatcttttaattaaattcaaattaattaatttggaaaattacatataaaggaagtcgaagcatatggcagacgtacaattagactggaacaacttggggtttgaatatcggaatcttccgtaccgttatcgtgcgtattggaaagatggtgcttggtacaaaaaagaattaacgggagatgcaactttacatattagtgaaggctcaacagcattacactatggtcaacaagactttgaaggcttaaaagcttaccgcactaaagatggtagtgttcaattattccggccagatcgtaatgcagcccgaatgcagaccagctgtgaacggttattaatgccacaagtgccgacagacatgtttgtggacgctgttaaacaggttgttaaggctaatcaagattacgtgccaccgtatggaactggtgcgactttatacttacggccattgatgatcggggttgggggtaacattggtgttcatccagctcaggaatacatcttcacggtctttgccatgccagttggtagttatttcaaaggcgggatgacgccaaccaactttacgacgtccgaatatgatcgtgcggcccataaaggaaccggggcttataaagttggtgggaattatgcggctagcttattcccaggtcaagaagctcatgccaacggtttctccgactgtgtttatcttgacccggttgaacatcgtaagattgaagaagtaggttcagcgaacttcttcgggattactaaggatggcacttttgtgacacccaagtcaccatcaattctaccttccgttacgaaatattcattactctacttggcagaacataaatttgggatgaagactgaacaaggcgacgtctacattgatgatttagaccggtttgctgaagctggggcttgtgggacagctgcggttatttcaccaatcggtggcttggaacatcaaggcaagttacacgtgttctacagtgaaacggaagttggtccggtaacgaaaaaattatatgatgaattaactggaattcaatttggcgatcgggaagcgcctgaaggttgggtccagaaagttgaattagactaagcacagtgttgtttgtgtgaataaaaagacggctttagtaagacccgtgatacgggtggaactaaagtcgtttttatgtgcgtgcgcatgatgcacgtggtattgtgaatagtaggaatgctgtctaatcagtagacgcatgatcgaaacgacagttattcggctaaggggacgttacggttaggttaagattgctgattgtgatgtaaagttgctgaagaaacgctaaaattaaagggagttgggcaagatgataaagtggagtaatcgacattggcaggcagttgaatgggtcagcacgggaattttggtgggctgtacgttactgtataatcatcaggttgtctcgaatcaatggcttctcgtcattggcggggccgctttaatcagttattggttggtcacattaccgcggttgttcagaagtcagcactagcttctggcaagtcgttgatgcaatcaggtcagttcgtatccgcagaaattgttagggtaaaacgtggacagtttgccaggttacttggttgatactgaccttgaaggcagtttagccacagtcaatcccaacttgaatcatgatcctaataagagagaatgaataaattaatgttaacttttagtagaaccgcagcactaattaaccaaatggtccaagatcaagtgatcccaggggcgagttatgccttgatcgatggggctgagtggcacacgaatcaagtgggcgtcgctcaaataaaaccaacgatcaaaccattatggccggatgcgatgtatgatttggcctcggttactaaggtcgtgggaacgacaaccgtggcaatgcagttgatgcaaaatgggcaacttgaaattgaccgccccgtgcatgactacctaccgactttacagtccacaacgattacggttcgtaatttgatgacccatacaagtgggctgagtggttatattccaaatcggaatgcgttgtcagcagatgcgttattagccgcgattcaacagctaccaatcagtgagcgtaaccgcaatcatcgggtggtttatacggatttaggcttgatcatcatggggcaagtcattgaacgaattcttggagcggccattcagtcaattatcactgagcgcgtcttgcagccattagggttagcacacacgagttttcaacctcaactagcgcaaaccgttccgacgacgtattccatgaaaactgggttgttacgggggatcgttcatgatcctaaggccagagtcttaggtgaacactgtggttccgccggtttatttgccagtgtgacagaccttgttcggttttcacaactgatgctcggccaaatcgacgtaccagctgtgctatcacaggccacgattgcaagcttgtatcaagattggacgcccaatcaacacttacgccggagttttggttggaacctctggcaccgttctaatgagacgctgccggtgattttccatactggttatactggtacgctcctgatgcttgaccgtcaacggcaacggggccttgttttcttatccaaccgggtgcatccagttgcaaataattcggtattccttccagcacgtcgccggttaattgcggcttggttggcggatacggttacaaattagctacttcggtttcacaaccgctttcatttatgctaaaatttagatattaaattcaacaatggagtgagtagatcttatgagtgagccatactttttaaagccggtgttccatgaaaaaatttggggcggtaccaaattacatgatgattttaattatgatattcccagtgatcatactggtgaatgttgggctatttcagctcatccgcatggtccagcgaccgttgaaaatgggccgtacgctggcatgacactggatcgagtatgggcagaacatcgtgatgtgttcggtgatgctaagggagatgtcttcccactattaacgaaaatcttggatgctagtgaagatttgtcggtgcaagtgcatcctgatgatgcgtacgcggctgaacacgagcacgaacttggcaagactgaatgctggtacgtgattgcggctgaaccgggtgcaacgatgatttatggtcatcatgcgaagacccgtgaacagctcgctgaatggatcaacaacggtgaatggaataagctattacggcgagtgcccgttaagcccggcgatttcctttatgtcccatctggaacgattcacgcggttggtaagggaattatggtgttagaaacgcagcagagttctgatacgacttaccggctatatgattgggaccgggtcgacaagaccactggtcagaagcgcgagctgcatttgcaacaatccattgatacaactaacgttccgcatcatgaccctgatcttgacatcacgactacccaggttggggatgcaacggtgaccaaatacgtccaatcaccattctttggtgtttggcaatggcggctaacaaatgggcaagcaacttttaaccggggaacagcaccttatacgttagtctctgtacttgatggtgaaggtagcattgtcgttgacggtcaagactatccattgagtaagggcgtccactttatcttgccatttgacgtaaaacaatggacattgaaaggcgatttacaaattattgcttcagaacctggggctaaggcataagtagttaaccccttgatgggataaaaaagattgatactggttggaagccaatatcaatctttttttgtgtatctactgatagtatcagtttattaataatcactatctgaaagtatataaatatttattatagcttgaaggggtttactaatgagaaggcttccaaaaactattatcattgtaaccaattaatacggatcaaactaaaaaatcgtcactggctggtaactaagtcagtggcgattttgagtgatacgttttaaggtttcacgataacgtttttagtgaggtcttcgttgagttgatccagtgcatcgaaggtgccttcagggtacttacgttgtaaggccagtttcaagattcgtttagcgagggcttcattgcgtgcaaggattggaccatggaagtaagacccaaaggtgttcttgtagataacgccctcagattgatctttgccattattgccgttaccttggagcacttgaccaaggggccgttcaccttcgcccaggaaggtcatcccgttgtggttttcaaaaccatagtaggtctggtgggtttcggcgttctcaatggttatattaccaataaagcgattgttatcctgactgagcgtgtaatgatctaaggcaccgatacccgcgatcttttcaccatgggccccaatgtagtaatggcccagcatttgaaagccaccacagattgctaataatgggccaccggcttcgatatatgcggtcaaggcgtcttttttcgtttgtaaatccttggaaacaatcgtttgctcgtaatcctgaccaccgccgaagagggcgaagtcatatttttcttcgtcaaaccgatcatccaagctaactaagtcaacagtgatgtcggcatccactgctttagcatagtagcgcattgctaaaatgttaccgatatcaccatacgtgttcattagatcgccgtagaggtgtgcggcgtgtagtgtataagtcatggttaagccatccccccatcgataatgccttgactagcaagttgttttcgtaattgcaacatcgcggtgtaagttgcgacgacgtagacttgcttggtcggtagtttttgaattgcggtcgtcatgttggtcaggtcaggaataatggttaactgatcttccggtaccccagcaacttttagccggaacgtgatatcacgataacgttcaccgccactaatataggcgggaatattcaatgccggtaatttttcaaaattaccatcccagatccaactagtatcaataccatctgcatagtttgcgttgagcagagcggcaaatgagaatggccggtcatcggtgctgattgtttgcaagacttggttaaggcccactggattcttgacgagaatcagcgtgacgtccttttcgccaacgtgaaaggtctcttgacgaccaaagacttgttcatcgttgtcgctaagggcgtgcgcgattttggccggcgtgacgtccatgaagcgcccaaccgcgtaggcagctagcgcattataaatattgtattgaccaccgatattaagatgcatggcctgaccgttgatttcaaagtctgagctagtcggtgtcatagcggttagggcgtttaatttgtatgtcaactgtggacgctcaaaaccgcagtggggacaataatacttgcccatattgctataagttcgactatggtaacgtaaaatatgctgacaacgcggacaaagcaggccatccgtatttgctggcgcttgttggtcatggtcgggctggtagtcaaatccgtaatacagtatcggattaggcaattgtttggcattgaagagtggcaaatcaccgttggcaataattgtcgcttcaggtgctaaagcaaccccgtctaagattttttgatatgtcgtgtagatttcaccatatcgatccatctggtcacggaaaatgttcgtgaagacaaaggcttttggtgtgatgtacttggtgaccatgattacgttagcttcgtcgacttctagaactgcgagtggcttttggtgcgctttaggtgcccgtaaaaaggtcgtgacgataccttgcttcatgttggatccgcttggattggttaaaatgtcagggtactgttcacgtaaaaccttgaccgtcaaggcggtcgttaacgttttaccgttggtcccagtgatgacgatgacgtcgtagtttttagcgagatgctttaaaatcgttggatcgagcttcagcgctaacttgccggggagtgagctcccaccgccacggaaggtgtgtaaaaaccaatatgcggatttacccgtccaggtggctaatgtactattaattgacataagttatcggtacccctaattcttgatttacctgggaaatgatcagtgtgaccaactaccgggtattaaaatcataattaccggacaaaatgtcctactctcaagtattttatactgaacgtccctaaaagaaaagtgatactcccgccatttaaccgcatattatcaattcgttaattagttttaatgacagaatgctgaaattcacggccaaatccgctataattgactagaaatgtgtaaaaaaggggaatgagtcgcttggcacagttattttttcgatatggcgcgatgaacagtggtaaaaccattgaaattttgaaagttgcccataactatgaggaacaagataagtcggtcattatcttaacgagtggcttagataatcgtgatggtgtgggctatgttgcgagtcgcattggccttaaacgtgaagcaacgccagtatttgatgataccaatatttttgagatcgttaaacaaacgaatccggatgctgcgtgcgttttaatcgacgaagcccaatttttgaaaaagcatcacgtcctagaattggctgacattgttgatgagctaaagattccagtgatgacgtttggtttaaagaatgattttcgtaacgaattgttcgaaggtagcaagtacctactgctatatgcggacaagatcgaagaaatgaagacgatctgctggttctgtcgtaaaaaagcaattatgaatttacggttccacgatggtcagcccgtttatgaaggcgaacaagttcaaatcgggggtaatgaggcgtactacccagtttgtcgtcatcattatttttacccgccgaaattaacaaagtgaggattaactgagaatggataagttttttgataagttacaagccgttgccgatcggtatgaggaactcggtgaactattaagtgatccggaagttatttcggattctcaacgtttcatgaagttatctaaggaaatgggtaatattcgtgaaacggttgaaaaatataatcactacaaggaagtcacgagtcagatcgaagaaaatgacgaattgcttcatgaaaagctcgacgatgagatgaacgcgatggtcaaagatgatttaaagaaccttaacgcggaaaaggatcaattggaacatgaaatcacgttattgatgttgcctaaagaccctaacgatgacaagaacatcatcatggaaattcacggtgctgctggtggtgacgaagctagtttgtttgctgcggacctgttcaacatgtactcgaagtacgcagaacgtcaaggctggcaagtagaagtggctgatcgtaatgaaactgaagttggtggctttaaagaaatcgttctgatcatttctggtgacaaggtctactctaagctgaagtatgagagtggcgcgcaccgggtacaacgggtgccagtgactgaatcagctgggcgggttcatacctcaactgcaacagtcggcgttatgccggaagcgcaggatgttgacattgatattgatcaaaaagatattcggaccgatgtctttcgttcatctggtgctggtggtcagcatatcaacaagacgtcttcagcggtgcggatgacccacttaccaaccggtatcgtggtctcgatgcaagaccaacgttcgcaacagcaaaaccgggccaaagcgatggaaatcttgcgggcacgggtctacgactactatcagtcacgggaacaaaacgaatatgatgctgaacgtaaatcagccgttgggacgggtgaccgttctgaacgtattcggacttacaattttccacaaaatcgggtgacggatcatcgaattgggttaacgctcaacaaacttgaccgggtgatgaacggcgagttagacgaagttattgatgccctcgttttagctgatcaagctgaaaaaatggagcgcttaactaatgaataagcccactcaacccacttattttgaagcccagcagtgggcttctttttgtctaaaaacggcccagttgccgactgatagtgctcgcttcctgttattgggcttgagtcggctagaccagacacaattactcattcgttaccgcgagccgctacccagtgctgtttggcatgcttatcagcaggggattgaccgggttgttgctggtgagccagtgcagtacgtactcggagacgcaccgttttatggactcacgttacaagttgatccagcagtgcttattcctagagtcgaaacagaagaattggtagactggattttgacggatgtcccagcgaaagcgccagttcgactcttagacgttggtaccggctcgggcgccattgcattggcaatcaaacacgaacggccggcatgggagattacggccagcgacatttcaaccgctgcgctgcaagttgccaaagccaatgcggaccgcctacatttagatgttaagctggttcacagtgatctattgaccagcgtatctgcgcagccgtttgatattattgtcagtaatccgccatacatcgctgcgagcgaaaaagacgtcatggacgccagcgtcctcgcccacgagccacaaacggccttatttgctgaccacgatgggttggcactttacgagcagttagcgacgacggttgccgatcatctgacttcgaccggtcgcttatacttggaattcggctaccatcagggaccggccttgcagacgcttttcgcgcagtcgatgcccgacgcgaccgtgacgctgcgacaagacatggcgggtcacgatcggatgctgcgagttgcaatgactctgactcggcaatagttgcgcgttatcctggagaatgctgataaaagcgggccgattaggtagactgctgtttgtaatccgcgtcccattctggccttcgggggtgggtgaacgcagtcgtcgatttgagctcgcgcataacccgcgttatctcaaatgtgagtcttatcctaagcgggctgtttttaacctgggaggtacggcgtgaatttatgagcaattgattaagtccgtgatgtaaataataaataatattatatgaaagtaacgatgaattaataataaagtagaggtttgaatatattatggaaacgaaagtatatacgccggcggagattccggccgctgcggcgttgttaactgcggggcagttagtggcattcccaacggagacggtctatgggctaggtgccgatgcggcaaatgtggatgctgttaagcaagtgtacttagctaaaggccgcccgagtgataatcctttgatcgtgcatgttgctgatgtggaaaccgttgagcggtttgctcaaccgttatcggaagcagccaagaagctgattaaggcgttttggccaggccccctgacgatgatttttaaattgaaaccagatgcgttggcaccagaagttactggtgggctgcagacggcggctttccgtaatcctgataatgaggcaaccctggctttgattcgtgcagccggaacgcctatcgtgggaccatccgctaatacatctggtaagccaagtccgacgacggcacaacacgtattgcatgatctacgtggtaaaattgctggtattctggatgatggtccgacgaaggttggcgttgaatctacagttctggatctttcaaccgaccaaccagcaattctacggcccggtgccgtaacgcctgaagcaatcgaacgggtcattggcatgccagttcaaaccgaattgcaccatgtcggagctaaggaagttcctaaggcgccggggatgaaatataagcactatgcgccaaacgcacaagtttatatcgttgatcgttcggaagattggccagaagcgctggcgtgggcagcccagcaagatgtgccaatgggcgttatggcaacagatgatattttaactaacaatcaaattccggctaattgcgaacaattttcgcttggagaagatattcaatcggcaagtcgggagctgttcgcgggcttgcggcactttgatactgagacggaaattaaagatattctgtgccaagcctttgaaaataaaggacttgggcttgcctacatgaaccgattaaataaatctgccggtcagactcattttagtgtataatgattgcaagtcgggaaaacccgaaagttgtcacttgcgaaatggaggagatttattcatgaattaccaggaacaagatccagaagtatgggctgcgattagtaaggaacaggcacggcaacaacataatattgagttgattgcttctgagaacatcgtttcaaagggcgtccgggcagcgcaggggagtgtgctgaccaataaatactctgaaggctatccgggtcaccgcttttacggtggtaacgaatacattgaccaagtggaaaccttagccattgaacgggctaagaaattatttggtgcggaatatgctaatgtgcaaccacactctggttcccaagccaatgcggctgcatatatggcactgattcaacctggtgaccgggtgatggggatgtcactagatgctgggggacacttaacacatggatctagtgtgaacttctctggtaaactttacgattttcaaggttatgggctcgatcctgaaaccgaagaattaaactatgatgcaattcttgcacaagcacaagattttcaaccaaagttaatcgttgcgggggcttctgcttatagtcgattgattgatttcaagaagtttcgcgagattgcagatcaagttggggccttattgatggttgatatggctcatattgccggcttagttgcggccgggctacatcctaatccagtgccatatgctgatgtggttacgacaacgacgcacaaaacgttacgggggccccgtggcggtatgattttagcgaaagaaaagtatggcaagaagatcaactcagccgttttccctggcaatcagggtgggccgttggatcacgtaattgcgggtaaagcgattgctttgggcgaagacttacagcctgagtttaaggtttatgcccaacatatcattgataatgccaaggcaatggcgaaggtcttcaatgactctgacttggttcgggttatttctggtggtacggacaatcatttaatgacgattgatgtcactaagtctggtttgaacggtcgccaagtacaagatctgttagatacggtttatattacggtcaacaaagaagcgattccgaatgagacgttaggggctttcaagacctctggtattcggttgggaacacctgcgattacgacccgtggttttgacgaagctgatgcaactaaggtcgctgaattgattttgcaagcgttacaagcaccgacagatcaagcaaacctagatgacgttaaacagcaagcaatggctttaacagcgaagcacccgatcgatgttgattaagtaatttatatcaggtctggttttttctctctaaattagctacaatagaaagaaatcactaaggagtgtgcgtagcaacatgggtaagtttgaggttttggatcatccgctcattcaacataaattgacgatcattcgggaaaagaactgtggtactaaggtcttccgggaaatggttaacgaaatttcaacgttgatggcgtacgaagtatcacgcgatatgccgttgaaggacattgagattgaaacaccgattgccaagtcaacgcaaaaaacgttggcaggtaagaaagtcgccattgtaccaatcttacgggctggcttagggatggttgacggtttcttaaacatgattccggcagctaaagttgggcacgttgggatgtatcgggatgaaaagaccttgaagccggtcgaatatttcgttaaattaccaagtgatatttcacaacggcaattatttgtcgttgatccaatgttagccactggtggttcagccatcatggcgatggatatgttgaaaaagcgcggcgcaagtaatattaagtttatgtgtttagttgcggcgcctgagggtgttaaggcacttcgggacgcacatccagacatcgacgtttacacggcagcacttgatgaccatttaaatgaagatggctacatcgttcctggtttgggcgatgcgggcgaccggttatttggtacgaagtaagttgcattgacaaaaggtagcaccgccaggcaatgtctggggggctacctttttattttccaaaattattaacaactttagctataatcatccgcattctgtgagttcattagtcatgaatcgtgactaaaacgtgctaatttctaagattaaaagcagccagctatggaccactggaaacgggtgtaagtgggcgtaaacatgctttgctggttcgtcctaagccgacttccagtcgtgacagtgttcgaatggctgacgaagatgtacctaacttttgatgaatttgtcgttgctttttacaaccagtaattttgtcaatcaactggcagactgaaaatgatattgagatagctcactaatcctgaattggtgtagtaaaatttaatctcttgacaaagtgctaatgcacctaacgctttgtttaaagttccagtgtcaaaatagtcagcgacaaattgtaccaagttaagtggccgttcatcagccatttgagcggcttaccgaccggaggggcttgggtgacaatgctcagtagccaaattattcttagtcggaagtgggttgcttccggcttagaataagactcgtatttgagatgacgcgggttatgcgttagctcaaatcgacgtcggctacgttccagcaattgtcacccagccccggaggtcggaataggacccacaccggctgacgtacaacaatctaattagcacgttttaatcaccgttaatgccaaataataatttgtacaacgcgtatattataggtagttattgacattaactgttgggggacactggataattagggtgttttagatggcgattacgctgtattggtcgaatattcggtaacgttgggtgagaaagtcacattatttcaggaatgttgtcataaatattatgatgttttgaactaatatcgtttttaggggctgttactggttcggttcaaacattgagttgacaattatttcggagacgagtagactaattgcaattaaacagttcctttaaattagctcagagaggctgaaaaggatgaacggacgtacgctttcaaggaagccgtgcgtaatttcggacagcctagccgctttgagtggtgggctgtcttttcttttgcaatcattcataaaaaggggtgcgttatgacaaagaaagcggcgtttcataatgatgaagtcgtgttagatattcatgaccgaccaaaattaggtagttggttaggcttgtcggtgcaacatctgttctcgatgtttggttccacggtattggtgccaatcctggtgggattaaatccaggtattgcgctgtttagctctggtgttgggacgctaatgtatatcctcatcacgcgcggaaagattccggcgtatatgggctcgagcttttcatttatcgttgtgatgcagtctctgatgaagaccgcaggatatccggccatcgctcaggggactgtcgcggtgggctgtgtgtacctgctagttagtttattagttactttaattggttctgactggatcgataaggcgcttcccccgatcgtcgtggggccgattgtgatggtaattgggttgtcactcgcagggacggcagctaaggacgcaacaatgaacgggagtagttatgatattaaatatttcggcgtcgcgatggcgacgatgttactgaccgtcatttttaacatgtacttgcgtggatttatgagtttagtaccgatattgttgggaatcgtctgtgggtatatcattgccgtgttagttggaatcgttgacttttctggtgtggaaaaagcgcagtggtttgcgatgcccgcctttcaattgccttttattagttatcatcctggcatttattggggcgcgattctgagtatggcaccaatcgcctttgtgacgatgtcagaacatatgggccatattatggtactcaataagttgactaagcggaatttcttcaaggatccaggtttgaaccatacattggctggcgacgggacagcctcgattatcgccggctttgtcggtggaccacccgtgacctcctatggtgaaaatattggggtgctggcaattacgcgggtccacagtatttatgtgctcggtggggccgccttttttgccatcgtctttagttttgtgggtaagttatccgcgttgatcgagagtattccatcacccgtcatcggtggggtcagctttctactgtttggggtaattgcttcaagtgggatgcgaattctgattgataataaagttgattttaatcagaagcgaaatttaatgattgcatcagcgattttggtcattggaattggcaatgcctatttacaactgggaagctttcagttcagtggtctagcagttgcaacggtgctcggaattgtgatgaacttggtgttgccaaagacggcggtaaatgagaagtaggccgtcattgcgcgtgccaagaatgaaaataaagtcaaaataatgaaaatccaacgatttgaaagcttaatgaaagcttgatattgttggatttttattgattgacgaaatgttgaaattattttgaattttttcgacggtggtggtattattacctttgtattttgattaggggtgtctctaatctaccatttcaggttacgataaaattgacgttgactagctcaaaggttaaggttatcgtagcaccgaaattaaaggaaagaggtgatattcagtgggtgatccagttcctacagtcaaattccttggactgacgtttaatatcgcgaatgacatctcagtaattgtgacttgtctgattgttttcttgtttgtttttttactttcgcgacatttaacaatgaagcccaagggtggacaaaatgtgctggagtggctcatcgagttcacgaatggcattgtcaaagggtcgatcaagggtaacgaagcgtctaacttcggtttgtacgcatttacattgtttctctttatcttcatcgctaaccaacttggattgttcattcacgttcaggtcgggcagtatacgtatctgaagagtccaaccgccgatccgattgtgactttgacgttatcgtttatgaccgttgcacttgcacatgctgcgggtgttcgtaagaaaggtatgggtggttatttgaaagaatacacacaaccttttgctgttttctcggttattaacgtctttgaacaatttaccgatttcctaactttaggtcttcggctgttcgggaacatctttgctggtgaaatgttactaacgaaggttgctgatttggcaaagagcaacggttggttgagctatgtttactcatttccaattgaactcttatggcaaggtttctcagtgtttatcgggagcattcaagcgttcgtgttcgtaaccttgacttcagtttatatttctcagaaggttaacgacgaggaataatttctagttttttaattttaaggaggatacacagattatgggagcaattgctgcaggtattgctatgtttggtgccgctttaggtgctggtattggtaacggtttggttatttctaagatgcttgaagggatggcccgtcaaccagaattatctggtcaattacggactaacatgttcatcggtgttgggttgatcgaatcaatgcctatcatttccttcgttgttgctttgatggttatgaacaagtaatcattggtcaacgagttcattttaatgaaaatgaaagaaggaggtgtcattagatgctctcgcatttaattatcggtgcatccggtctctaccttggtgatatgttgtttatcgggattagctttattgttttgatggcattgatctctgttgttgcttggaagcccatcacaaaaatgatggctgatcgagctgacaagattgcgaacgacattgattcagcacaaaagtcacggcaagaagcgagtgacttagctgatcaacggcgtgatgcgctatcacactctcgcgctgaagcgagtgaaattgtcgctgacgcgaaaaagagtggcgaaaagcaacggtcaagtatcgttgccgatgcgcaaaacgaagcaacgcagtataaacaaaatgcgcgtaaggatattgaacaggagcgtcaagatgccttgaagaacgtccaatcagacgtcgctgacatttcggttgcgattgctacgaagattattaagaagcaattggatccggaaggccaacaggcattaattaattcgtatattgaagggttgggaaagcatgagtcttgataatcttacaattgcaagtcgttattcaaaggcactctttgaacttgcagttgaaaaagatcagaccgaagcattcctggccgagttaaagcaattacggcaagtctttgtcgacaacccgcaattggcagaggtcctctcaggatcattgcttccggttgatcaaaaacagacaacgttgtcaactttgactgaccacgcttcagaatacattaaaaactttattcaaatgttgtatgattacggccgcatgtcgaacttagttggcattgttgacgcgtttgaagcacgtttcgatgagagtcgcaaaatagtgcatgccgaagtaacgtctgcggtcaagttgtcagatgagcaagctgatgcaatcgcaaaggcattcgccaaacgtgttggtgccaatcaggttgttttgtcacgtaaagtcgatgaagcaatcattggcggtgtaattgtgaagtcaaataatcaaacgtttgatggtagcgttgcgttacaactaacgaatttaagacgagcactcatcaacaattagtttacgaagaggtgaaacttttatgagcattaaatctgaagaaatcagtgctctaatcaaacaacaattagaaagttatcaaactgagctctcagttgctgaaaccggtactgtcacctacgttggtgatgggatcgcccgtgctcacggactcgacaacgccttacaaggtgaattactcgaattcagtaacggagtttacgggatggtacaaaacctcgaaagcaacgatgttggtatcgttgttttaggggattttgatggtattcgtgaaggcgatactgttaagcggactggccgcatcatggaagttccagtcggtgacgccatgattggccgggtcgttaacccattaggtcaaccagttgacggtttaggtgagattaagaccacgaatacgcggccaatcgaacataaagctcctggtattatgcaacggcaatcagttagcgaaccacttcaaactgggatcaaggccattgatgccttagttccaattggtcggggccaacgtgaattgattatcggtgaccgtaagactgggaagacgtccgttgccattgatgccattttgaaccaaaaggaccaagacatgatttgtgtctacgttgcaatcggtcaaaaggactcaactgtacgggcccaagttgaaacgttgaagaagttaggtgcgatggactacacaatcgttgtaactgccggacctgctgaaccagcgccattactgtacttagctccttatgctggggcagcgatgggtgaagaatttatgatgaacggcaagcacgttttgatcgtctatgatgacctttcaaagcaagcaacggcttaccgtgaactttccttgatcctccgtcgtcctccaggtcgtgaagcttatcctggggatgtcttctacttgcactcacggttactcgaacgggctgccaagttgagcgatgaattgggtggcggttcaatgacggccttaccaattatcgaaacgcaagctggggatatttcggcttatattccaactaacgttatttcaatcaccgatgggcaaatcttcttggatagtgattcattctattcaggtgtgcggccagcgattgatgccggggcctctgtttcccgggttggtggggatgcgcaaattaaagcgatgaagtccgttgccgggaccttgcgtcttgacttggcttcttatcgtgaattggaatccttctcacaattcggttctgacttggatgctgcaacccaagcgaaattaaatcgtgggcaacggatcgttgaagtcttaaaacaacctgttcattcaccattgaaggtcgaagaacaagtaatgattttatatgctttgaccaacggttatttggataaagtggcagttgatgatattgcccgttaccaaagtgaattgtttgaatttattcatgctagtcatcaggacctctttgatacgattttggcaaccaagaagttaccagaagctgataagatgaatggggccttagatgcgtttgcagaacaattccagccaaccgctgccgctgcgaagtagttatggctgaaaaggatggtgagtagtgcatggcagaatcattaatggatgtcaagcgccgaattgactcaacaaagaagactcatcaaattacgtcggcaatgcaaatggtctcaacttcaaaattgaaccagattcaaaagcataccagcacgtatcaggtgtacgcttctaaagttgaaagcatcgtttcacatcttgccaaagctcatctgatgtcagcaagtgccggtgttgctaacagtaattcgaatacgatttcagttagtgaattgctcgcgcaacgccccgttaaaaagactggtttattggtgatcacttcggaccgtggcctcgttggtagttacaacagtaacgtgttgaaacagactaacgatttcatgcggacgcacaaggttgatgccgataacgcagtcgttttggcggttggtggcactggtgcggatttctataaaaagaacgggttaaacgtggcttatgagtaccgcggcgtctctgatgtcccaacttttaaagaggttcgtgaaatcgttaagacagtcacatcaatgtaccacaacgaagtctttgatgaactttacgtcttctacaaccactttattaatcggctctcttctggttttcgggccgttaagatgttaccgatctccgaagagacctttgaacaaagtgagtcagataatcgtaaagccaaggatagccgggtagatgtcggtcccgagtatgaaatggaaccgtcagaagaagccattttgtcggccgtgttgccacaatatgctgaaagcttggtttatggtgcaatcttggatgccaagactgctgaacatgcttcgtcgtcaaccgcgatgaaggctgcatcagataacgctggcgatttaatcgataaattaaatctgaaatataaccgcgcacgtcaagctgctattaccactgaaatcactgaaatcactggtggtttggttgcgcaagaataacgaagtgggaggaattaacgactaatgagtacaggtaaagttgtacaagttattggacccgttgttgacgttgaattctctctgaacgataagttacccgatattaataacgccttgatcattcagaaggacaacgatgacactttaacggtggaagtatcgttggaattaggtgatggggttgttcggaccgtcgcgatggatggtacggatggcttgcgccggggaatgacagttgaagacactggttcttcaattactgttcccgttggtaaagagacgttaggccgggtcttcaacgttttaggggaaaccattgatggtggtccagaattcggtccagacgcagaacgtaacccgattcatcgggatgcgcctaaatatgatgaattaacgaccagtactgaagtattggaaactggaattaaagttattgacctcttagcaccttatgttcgtggtggtaagattgggttgttcggtggtgccggtgttggtaaaactgttttaatccaggaattaattcataacattgcccaagaacataacgggatttccgtgtttaccggtgttggtgaacggacgcgtgaagggaatgacctttacttcgaaatgaaggcttccggcgttttgaagaataccgccatggtttatggtcaaatgaacgaaccacctggtgcccggatgcgggtggccttgaccggtttgacgattgcggaatacttccgtgatgttcaaggtcaagacgtgttgttattcatcgacaatatcttccggttcacgcaagctggttctgaagtttccgccttacttggtcggattccttcagccgttggttaccaaccaaccttagccactgaaatgggtcaattacaagaacggatcacttctaccaagaaggggtcagttacttcgattcaagccgtttatgtacctgccgatgattataccgacccggcacctgcaacgactttcgcccatttggatgcgacgaccaacttggaacgttctttgacggaacaagggatctacccagccgttgacccattagcttcttcttcaatcgctctggacccatcaatcgtgggtgaagaacattatcaagttgcaacggaagttcaacgggtcttgcaacgttatcgtgaattgcaagatattatctcgattttagggatggatgaattatctgacgaagaaaagacaactgttgcgcgtgcacggcggattcaattcttcttgtcacaaaacttcttcgttgccgaaaactttacgggccaacctggttcgtatgtgccaatcaacgataccatcaagggcttcaaagaaattcttgaaggtaaatatgatgacctaccagaagacgcattccgtcaagttggtaagatcgacgacgtggtcgaaaaagcgaaatcgatggtaactgattaggaggggtttacatggctgacaatgcaaaatcattaaccgttagcatcgtaactccagacggtcaggtctatgagaataagacgccaatgttgatcgtgcgaacgattgacggcgaactcggaattttgccgaaccatattcctgtgattgcatcgcttgcaatcgatgaggttcggatcaagcaacttgaaagtgatcaggaagatgacgaaattgccgttaatggtggttttgttgagttcagtaataatacggcaacgattgttgccgatagtgctgaacgtcagaatgacattgacgttgctcgagctgaaaatgcacggaaacgcgctgaaacacggattcaaaatgcccaacaaaagcacgatgatgctgagttggcgcgggcccaagtcgctttgcggcgtgccatgaaccgtttgaatgttgctcggcattaacaacttaaaattctgaaaagcatctgcaattatttgcgggtgctttttttgtgcggttcagttaagccgcgatgcacaagttagtcaaacttaccgcggtgagtcgtacccgttactgtccagttttaagcttgcacggttcaaagcagattggaaccgtgggttgatcaagggccaagcactggcttactaatggcgatatcgcgttgttaactagaagaatcggtctgattcgaatatttttcgccaacattgcatcagtatctggcagagcagtaattaagacgtggatcgcgtcttaaaagggtgatcatcacgttccgacaattggcagcaattccaaaggtcggcataggaaacatgaacaactaagtttacagcgaacttaaacgtttcagtggccaattttatcgcgacgttgaaatgttttgtccagtcggcgcggatgttcgtgaactagattttactaatcgattgagcgtattaggggcattgcgataagttgaatggtagaatgcaacttatattgagattacaataaagaaaacgattacaaatgaacgatactgctaatcaatatgggtatggcttgtcaaatgattgcacgacggacttctaattagttaactaatcataagtatttaatatttgtgttgaaattgtaacgaaaatgtaaaatgtaatatttatccactagtgttctatggtatgatgattaggaaccgatttgaacctgcatgctgctattggcaagttgccatggtgtgtccaggttgttttgatggttgagctggtgtttggattgcacaccgcgcgttgccgatttgcttagtacagcggtgaacagtggaatttgggcaggtgcgaggcatctgatccaatcgggttcttttagtaagtgtgctttttacgcaatccgaaatctcacgtaacttgtttgttgattatcgtttagtgatggagggtttatccatggaggaaattgtagttcatggcggtcaacgtttgacaggaaatgtccatattgagggcgctaaaaatgccgtgttaccaatcttagccgcaagcttgttggctagttctggtcagacacatttatcaaatgtaccagtgttatcagacgtttttacaatgaacaacgtcttgaaatttttgaatactaaaattgattttgatgaaattaataaaacaattgatattgacgctagtcgtcaattatcatccgaagcaccatttcaatacgtatccaaaatgcgtgcttcaatcgtggtcatgggaccactattagcacgattaggccatgcgaaagtcgcgatgccaggtggctgtgcgattggttcacgaccaatcgatttacacttaaagggactgaacgcgcttggtgctgaaatcgaacgccacgatggctatgttgaagcaaccgcgaaccagttacacggagcggccatttacttagattttccaagtgttggggcaacgcagaacataatgatggcggcaacacttgcagatggcatcacgacgatggaaaacgtcgctcgtgaacctgaaattgtggacctagcgaactatttgaatcagatgggcgctaaggttaccggggcaggtactgaaacgatccgcattgaaggggttaaagcgatgcatggctgtgaccatagtatcgttcaggatcggattgaagctgggacattcatggtcgctgctgcggtgactcagggaaacgtcttggttgaggatgctattgccgaacataataagccattgatctcgaagatgcgtgagatgggcgtcacagtaacggaagaaccggctggtattcgggttattggtccagaaatcttgaagccaacctccgttaagacgatgccccatccgggtttcccaacggatatgcaaccacaaatgacaattttgcagttgtgtgcgcagggcactagtttattaactgaaacggtttttgagaatcgcttcatgcatcttgatgagttacggcgaatgaacgccgacttcaaagttgaagggcgctccgtcattatgtatggtcccactgactttaacggggcccaggtcactgcgacggatcttcgggcagctgcagcgttagtaatcgctggactggtcagtcggggttacactgaagtgactaatttgaagtatcttgatcggggctactttaacttccatggtaagctggctaaattaggtgctgagattaaacgagttgatgttcccgatggcaccgtttatgcgttgaatcctgattttgcgaacgaagctgcggaataaatcgaaataaatgcttacaaaaccttcaaagtgcgataaactcgtttttgaaggcttttttgtggcgaagcggggtaacccggcgccaacattcaggaggacagcttatgtttattaatattatcgacaaacacatttcattgaaaccaactgaagtggctgacgcggagccgcttttcgacttagttgatcataatcgcgaccatttgaagttatggatgccgtgggttgatgcgacggcgaccgtgcaagacgagcgtcattttatcgaatcgatgttgaccaagcaggctcatggacaggtgtttatcaccaccatcattgtggatggcgaagtcgctgggatgctagacttgcataatattagtgccattaatcacaacggtgagattggctactggctgggccagaaatatactggtcgtggcgtcatgactaaagcgctcgaacgattagaagaaattgcttttacggagcttgatctgcacaaggtcatcttaggtgcagacgttgccaaccaggcaagtcgggctgttgctgagcgacgccaatatcatttggatgcgaccctgccagaaaatatcttgttaaatggtcaatatcgtgatgaagcaatttattcgctgacggtcgatgagtggtcgaaacgacaggatgattaggcacagccaattgattggtagtgacaaatgaacgagtggctaggacagccgtcagttctcatcaactgtagagtatggtataatgattagtcgtataattgtatgtttgagaggagcaaaaacatggctttagatattggtattgacttaggtactgccaatgttttaatttacgtatcgggtaagggcatcgtccttaacgaaccatccgtggtcgctatcgatacgaacacgaatcaagtgttggcagtcgggtccgaagcctaccaaatggttggaaagacgcctagtaacattcgggcaattcgaccattaaaagacggagtaatttcggattttgatgtcaccgaagaaatgctgtcctattttattaaaaaattaaatgtccgtggcattatgtcgcggccaagtatcatgatctgtaccccaacgaacactactgaaattgaacgcaaggcaatcttgcaagctgctgaaaaatctggcggtaacaaggtttacttggaagttgaaccaaaagtggcggctattggcgcagggatggatattttccaaccacgtgggaacatggtcattgacattggtggtgggactagtgatatcgctgtcctatcattaggtgacattgtggcaagtagttcgttacgaatggccggcgaccggatgaatcaggacatcgtgaactacgtcaaagatcaacatcacttgttgatcggtgaacgcagtgcagaacaagttaagattcaaatcgcacaagttttcaagcaggacggcgatgatgataaggtcacccaagttcgtggtcgagatactgtgacggggatgccgcgctcaattgacattgactccaatcaagttgaagaagctattcacgaaacgctgatgcagatcgttagcacggcccatcacgtgatggaaactttaccaccagaaattgcggccgatattattgaccgtggaattacgttgactggtggtggcgcactgttgagtggcctcgatcaattgatcagtgaaaacttaaaggtgcccgtaatggttgccgaacacccattgaacaacgttgctcagggggctggaattttacttgaacatatgcagaaaactgctaagaacaagaaataaattacgatgcgacggttattaatgaaaggcatccgcttttatcagcgggccttttctgcgtttagtccggctcattgtcgctattatccaacctgttctaattacacgttagaagcgatcgatcggtttggcgcagttaaaggcgttctaatgggagttgcacgtatcttacgttgtcagcccttagttaagggcggctttgatccggtaccagcccatttttcattgcgtcgtaatccgcaatacaaggaggaagaccaccgtggcaagaaaagataaggcgatttcggtcactttaaacgaaactaaggtcaacggtcaaccagttaccgaagttttgatcggtaaacaagtgattggacaagtgactcaagtcggtgaacgatttgaagctgaaatggttagtgacaaccaaccatttgcgcataccaaatcttttgatgagagtctgcaagagatcttgtcggcttaccatctacacaaaggctaatttttagtaaaccttcaacctggttccgagaattcggcaccaggttgttgtataataaaaactatcttaaagtacaaaatgatattgtgaataggattagtctgacgcgtgcggtgggctaatcccaacaggttaggagcgttatttgtggcagaagaatctagactccgcagtcaagacgaggattcaagaattgactggggtatcatattttcagtgatgatgctaggattgatcgggctggcgtcgatttatgtcgccgcagtgcacgactctagttcagtaaacgtcacgaagcaggtgatttctcaagtcatgtggttcgtgattgggaccgcgattgccgtaattgtgatgcaatttgattcggaacagttatggcgagtggcaccgattgcctattggtttgggatcttcctgcttgcggccgttttggtcttgtacagtagatcactgtttgcgagcactggggctaaaagttggttcgcagttggttccttgacgttgcaaccgtctgaagtcatgaagcccgccttcatcttgatgcttggacgagtcgtgacaatgcataacacggagcacccaacacatacgatggcgagcgattggcaactcattgggaagttaattgcgtacatggtgccagttgctatccttttgaagttacaaaatgactttgggacgatgctggtgttcttcgcgattcttgggggcgttatcttagtttctgggatttcgtggcgattattggcaccgacgtttgccattgtggcggcgattgcggggactgcgttatatctcgtgatctcgcagagtggtcgccatattttggaagctatcggttttaagcaataccaatttgcgcggatcgatacgtggttgaatccgtcgacggacacgtctaacaatgcttatcaagtttggcagagtatgaaagcgattggttcaggtcagattactgggcggggatttaacgtttcccacgtgactgttcctgtgcgtgaatctgatatgattttctcggtaattggtgaaaactttggctttatcggttgtgccgtggtcattttattgtatttcttattgatttaccagatgatccgagtgacgtttgatacgaagaacgaattctacgcttacatttcaaccggggtcattatgatgattctcttccacgtgttcgaaaatattgggatgagtatcggactgttaccaatgactgggattcccttgccgtttattagtcaagggggttcggcgttgattgccaatatggctgggataggtttaatgatgtcgatgcgatatcattacaagtcctacatgttcagtcgtaacgaccggtttgaatagtaaaattattgtaaaggtatggtgtttagtatgagtgaagatgcagcttatttttggacaaaagacgttgatggacatacgcggttaggtttaactaaggccgcccatgaggctcttggtgaagtgaaatatgctgagttaccagctatcggtgacaaggtcagtcagaacagcgcttttctgagcgttgaagcgaccaaagccgtttctgaattcaactgtccaatcaatgggaccgtggttgcggtcaacccggcgttgagtgagaacttcgatgcgttaaatagcgttgaagacggcgttgcttggttaatcgacgtggactaattgccaggccttgacaattagaaacaggctcggtatactcgttacattaacaattgattaaaaaagttatcattttgaaaagatgagtacgcggttatgattacttagagagtccctggttggtgaaaggggattaatcgtgaagctgaagatggtcttgaagtaatgaagtttagtgagcagtcgcaagctaagcttgggtcgcacccattatcatgcggagttcaaagtaactcttgagacaactggcgtgagctagttgtgaagatgggtggtaccacgaggctaagcttctcgtcctattgatgattattgtcgtaattgtctgggatgaggagctttttttgatgcgtaaggaggaattgacttgattgaatttaaagatgtgacgaaaacctttgatgctaagcaaggggcggttcacgccgttcaagatgttaatttaaaaatcgaagatggtcacatttatggcattgttggctattcgggtgctggtaaaagtactctggtacggatgctgaatggcttagagacacccactagtgggtcagttgtgattgatgatgtcaatattacaacgttgagcggggccaagttacgcgcccaacgtcaaaagatcggcatgatttttcaacattttaatctattatggtcgcggaccgttttggagaatattatgtttccacttgaaattgctggtctgtccaaggtggatgcccgtaagaaagccgaacacttagcagacttggttgggttggccggtcgggaaacggcttatccgtcagaattatcaggtggtcagaagcaacgggtcgggattgcccgggcacttgcgaatgatcctcagattttactttctgatgaagccactagtgccctagacccgcagacaactgatgaagtgttggatctgttgttatcgatcaaccagaagctccatttgacgatcgtattgattacgcatgagatgcacgtgattcgtaagattgctgatcatgtcgcggtgatggaagctggtaaaatcgtcgaacaaggaccagtacttgaagtcttcaagcgaccacagcaggctgtgactaagcggtttgttaatgaagaggtcacgccgtcgctgaatgacacaacggtggtcgtggaccagttactggcgaaatatccaaagggaaccatcgtacaactgacgttccatggcgatcaagcccagctaccgattgtttcagagatgttgaagaagtatccgttagatttaaatattattgagggtgggattcaccaaacccaagaaggggcgattggttcgctgtacttacaactaacgggtgatcaggaacagattaagggcgctctagcgtacctacaaacgatgcgggtggaaacggaggtcttgaaccgtgaatgatcaaggattagattcatattttaaatttgcaaatgtcgattggggtagcatgatgtcggccacgtgggaaacaatttggttgacgattgtgtcgatggtcgtagttgccattctcggaatcgccttaggtctgttactttatgagacggcggggagtcagaatccgctggctaaggccttgaattggattgtcgcgctgttcgtcaacgttttccggtcgattcctttcattattttgatcgtgctattattgccggtaacgtctaagttagttggaacgattatcggaccgcgcgcggccttaccatcactgattatttctgctgcgccattctatgcgcggatggttgaattggccttccatgaattggatcatggagtgattgaggccgctgaatcaatgggggcgacccggtggcagattattcgaaaagtcctattgccagaaagcatgccggcattagtttctggaatcacggtcacgacgatttcattaattggctacaccgcgatggcaggagccattggtgctggtggtctgggtaatttggcctaccaagacgggtttcagtccaataacaacgccatcacattagtggcgacggtaatcattgtgattatcgtgtttatcttccaatttatcggggatattgcagttcggcatattgataaacgggttaattaaagttcgtataggaggaaacggaattatgaaaaaaaagggaattctaggattattagcagttgcggcaacggcaattttgttagtcggttgtgggaagtcatcgtcaacaaagacaacaaccattactgtaggggcttcttcagtgccacacgcacaaatcttgaagcacgtgcagccagaattgaaaaaggaaggcgttaacttgaagatcaaagtctttcaagattacgtcttacctaataaggcattggcttcgaaagaattagatgccaactacttccaacacatcccattcttggataactggaataaggaaaataatgggagcctcgtatcagcggggaaggttcacttggaaccaatcggtgtttattccaagaaagttaagagtctaaaagacttgaaagacggcgcaaccgttctggtcagcagcaacgtggctgactatggtcgggtcctgacgttatttaaggatgcgggtttaattactttgaaaaaagggacagatttaacttcagcaacttttaatgacattaagaccaacaaacgtcatttgaagtttaaacattcatacgaagctaagttaatgccaacattctacaaaaataacgagggtgacgcggtcgttattaacgcgaactacgcggttcaagctgggttgaatcctaagaaggatgcgattgcacttgaaaaatcagattcaccatatgccaacattgtggctgttcgtaagggtgataagaacaagccagctattaagaaactaatgaaagctttacgttctaagagcacccagaaatggattgaaaagaagtacaagggtgccatcctgccagtttcggccgactaaacggaccatcttaaatcagaatattgattgattgagctagcttcagggattccctgaggctagcttttttcacggagtttgactacggtaactttccgaagcgggttaatgaaaatgcacgtttgatattatctaagtagtactattgattaaattcttatgagacagcgtcctgcttgactttatagcggttgcaaggtacgctaaccaagttaaataaactacagattggggtttgcagcatgcgtaaatatggtgtgatcgggttaggccaagtcggtgcgacagtggcttatacgttggttcaacaaggaaccgttgatgaattagttttaatcgataagaatgaggccttggccaaggcgcaaaaactcgatttagacgacgcgtcacctcgtctaagctcaaccactaagattattttaaacgattattcagctttggccgatgccgaagtgttgatcgtggcttctggcaatattggtgccattgatatgaatagttccaagggtcgctttggtgagtatgatttaaaccaagcgattgtacgggagatcgcgcccaagattgtggcatctggcttcaagggtattttgatcgatattatgaatccgtgtgacgtcatgacggattatttacaacgaatgacaggttttccacggcaacgggtttttggtacggggaccttcttagatacggcgcggatgcaaaagtatgtcggacaagcagctggtacgaatggtaaaaatgttgcggggtacgtatatggcgaacacggcaactcacaatttgtagcttggtcaacggttagcgtcaatgggcagcctatcaaaaatttcccaggtctgaaccttgatcaacttgaagaagatgcaaggcaaggggcatttgcagtcatggcgggtaagcattatacaaactttgcgattgctacttgtggtgtccgattggcagaagctgtcagcgcggatgcacaactggcttgcccagtttcagcttttgatccgcaatatgggacatacgttggcatgcctgctgtgattggtaaaaacgggattgaatcattaattcaactagatctgaccactgatgaacgagcgtcgttagcagcgtcagcgaagtttatcaagtcgcaagtggacgttttaccgcaagcataagctttttctaagcatggattgaaacatcttgtcattaaacgtggcctaatcagggtgtgcggtgtggacttgggtattggctcaggttggcttcgtgacgtctataattaggtcacgttttatgattgaatggttcttttgggcagacaggcgctgacatgctaaaatagaaggtaaattcgagattacgaggtcattatgcaagcagagaaattgatgcaggttaaggatgcagtgttaaagttaagacaacaacttcgagcgggacaaatctatcagtcactgcccagtcgaatggcaacgctgattaagcagttaccgagtaccgtgacaaccacggtaacgattccgagcgacgaagaggtgcttccactgattgcaacacttcatgagcagttgaagaaaggcacgttgaccgcgatgagcgacgatcaaatcaaattattgatggcacacgttggttcgctgaatccgctggttcgtgatcaaggcgtctactatttgttaaacgaggcattacagcaggtactcacaccggaacagttgggcgatatttttgatcagttgattcaagatcagatgttatttgcacacatcgatgagccgcaaaatgatgccatttatcagcggtcatttgcgatactattactgtcagtgctcttgtatgcggaccatgcgggtctcaagtttatgacacccgcgcggctggatctagttgttgagcaaatgacagtctacattttactcgaaaaggatactcgggggtttgtgggcaccaccggttgggcgcatgcgtacacgcatattggcaatatcttagatgaactggcagatgagtctcaactcgcacgtgcggataaattattactgttggccgcattgattgctcgttatcaaaagttaacaacgccgttgatttttggcgagccagaacgactatcgacttatttgaccttgattacaaacaaacatgagctttattgtgattatttgttaactgcgatgaaggactggcatcagcagttgatgatgcatactcgtccggctagtgaagctgaatggacgcagattttcaatcgtaatcgattattggaagcacttgcattacacgatgatctgccaacggccgtcgtagattatttggatgatgaattagaatttttaggttagttttggaaggaagtcttttgaatgcaggcaaaagcagttggattaacgcaagggttgccagtgagcgatccgaatagtttacaagatgtcaccattaatgtaaatcaacctcgtggccgtgatatcttagtagccgtcttagcaaccgcagtcaatccaatcgatacgaagcagcggcaaggtcaatcgccagtgacaacgccgcgaatactaggttttgatgccgttgctaaagtgttggcggtcggtgaagcagtgacaacgattatgacagatgatgtcgtttattatgctggcgccgtcgatcggccggggagtgatgctcagtatcaattggttgatgaacggttagttgcgtgtgccccgaaaacgtggtcgccggcgcagtcagctggtctgccgctaacgacactgacagcttgggaagcattgtttgaaaaattaccattcactgcagcggctgacgcgaatcttggtcagagcgtccttatcatcaatggtgctggtggggttggctcgatggccatccagttggcaaagtgggcgggtcttcaagttattacgacgactggtaagccagaaaccactgaattggttaagcggttaggtgctgatatcgtcttagattaccatcaagatctgggatcgcaattagctgcggccggtttgcaggctgtcgatcatgcgatactattacactctacggatcaatacttgccattagtgacaccgctagtccggccacttggcacgatcgtcgccgtagtgacaaatcagcaccccttgccaatggcgttactaaagccgaaaagtttgaattttgcttgggagtttatgtttacgaaggctaactatcagttgccatcgatggcgacgcaggggagtattctggcacaggtagcgcaactggccgatgccggggtgattgtaccgacgaccaagcggactttagctggaattaatgcagcaaatttgcgaactgcgcacacaatcgtagagacggggcaaatgttgggtaagattgtcttgactgcgccatttgacgcgtaaaaaacaacgttttattgtaaaaatgttttcaattgtgctcagatattgtagaattaactaagccgtagtatgaaataaaccttgataggatgaacaaaattatggagacacaaaaaaagatccatgttggtatgttgtttggtggtaactcttcagaacatgatgtttcgaagcgttcagcgcacaacatttatgatgccatggacaagaataagtacgagattgacttgtttttaatcacgaagaacgggattgtcttgagtgatgctgcaactcggcgcgtatttgatggtgaaccagaagatcaagtcgtcgccgaagaaatgccaaagttggacatgagtgatccattagctcccatcaagaacctgacactggccaaagatattgatatcttctatccagtggttcatggtaacttaggggaagatggtactttacaagggctgttcaagttattgaaaaagccgtatgttggtagtggtgtcttagcgtcggcagctagttttgataaggatattacgaagcagattttaacgcatcatcatattcaaaacaccaagtacgtggtggttacaccggaaaaccgggaccaaatgacgtacgcttatttacaagcccacgtgggtgatcatttattcattaagccagccaatcaaggatcgtcgattgggattcataaagctgagaatgaacaagaatacttggatggtttggccgatgcgttcaaatatgactacaagattttagttgaagaatcgattgacaatccgcgtgaagtggaatgctcgatcttaggcaatgaaaatcctaaggcatctaagcttggtgccattgatgtgccgaagacggacacgttctacgactataataataagttcgtggatgcgagtggtgtaacgttcgaattaccagtcgaattaccagctgatttgacgaaacggattcaacagatgtcgctagacgcgtttaaagcgcttggtctaaaaggaatggcacgcgtcgatttcttagtgtctgaagatggtgaaccatacttgggtgaaatcaatacgttacctggttttactaacattagtttatatccaaagctatgggaagtttcgggcattagttatacggcgttgatcgatcaattgatccaacttggttttgatgaattcaaacgtcaatctgatattcactatgatttcgttgcgttagacgcggaataagatagtaatgagttttgtggtggttgggatgaagcgattcatcacggccgcctttttttgtgaggaggggtcaggttgttaagtcgcggatggcacttagtgatgcagggagcgcgccaactggctggaccgctagcctgctggtggttggccggcatattgctggcggtactcgctaaggtgctcgggattctggtcggtggggtagtcagcttgctaggcttgttgcttttgagtgcctggttaccagccatggtcgctcgtagtaatcatgagtcgtggcaggccggtcaatttttgtatcgctgggtgctgttaatgtttacggcggtgtggtggttaccactcggttggttaggctatttagcaactttacaagcgagcatacaattgccagcgactgttcaaaatataatctttaatacgcgttatgactggcttcctgtggcgggaccactttggctgttgggctggctgattagctggaagtggttaccagcacttcaacgccaattgaccgctccgaccagctggcgtaattattggcgaacgggttggcggatttcctggtggacagtctttaaaaaaagtcgaaatgtgtggctgttcctgattagctggctcgttatggcaatcattagtggtggcatagtgtgggctagtggcgctgttagccagctggtcagtcaatttattgcagttttcatgatgactgggttgcaactgctggcttggttaatgtttatgggatggtggtcgtgcctttggccagaaacagcaatcgccggtcactctaactggcaaactgggctacttacgttgaccggtttgctagtcttgggtggttgcgcaggctggtggctaggaacgccaccaacggcgccgctagcaattattgcacatcggggtgttaatggtcgtgacggtgtccaaaataccacagcggcgcttaaaaggactgtaaagcaagttcagcctgatatggtcgaaatggatatccagccgacagcggatcgccactgggtcgtcatgcatgatccaacgctgaaagctttagcgggtcaacccggtcccgttcatgagtaccccgttgataagttgagtggattaccactacgggagcatggtcaaaaaggctacttgagtacgtttaagcagtactttgcggtggcacacaaattacagcaacctttattagtcgaaatcaagtcagttgggacggctgatcaactaatggggatttttgccgacaactatgcacaacgactgatacaacaaaaaggggcggtacactctttggactatcgtgtgattgaacgattacatcaacgggcggcgcaactaccggttggcttcataacgccgttttatctgacggatttttctaattccgtcgcgggattttattctttacaagcactgaccgcgacccgtgagcagatcagtgcggcccaccgccaacatcggatcgtctacttctggactgttgatcggccgcttgcaatgcagcgactgacggccatgggggctgacgggctgatcacaaatcgaccgggccaactacgaagattacagggtcaatctaagcattattatttttatcaattgataaattggttagttagttggttataaactactgaaagaagtatgagaactaatcttaattattaagccacgtcaaccgattaattgagggtgtcatgacaattgatgtttgctgttaataaggttaattcgctcccctttaaatcgctttcagtagttctcacttttaatgaacaagtccttgattagggtggctaacgaactgtaagcctggataattaataaatgaccttcggccgatatcatggtataaacttaatattaaataagaattacgcgtatttcttgctaaaattccgttatgtgaatataattatatgcgtaattggtattgtccaattggttagtgctcaattattcgaacggattaacgaggattgattaggtgtcacgatacccttgttcatttagtgggggcagcaaggggagttacaaaatgagtttggtttaaggcaatcaatgaagaggggttaagcatgagaatattaggagaaaaagtgcggcagttcagaaagcggaagggcatgtcgcagaaggaactggctgatgggatttgtactcaggcaacgattagtctaatcgagaaaaaaagtaaaattccaagtatgaagattatgatgaaaatttgtaatcgattaggaattcgtttatcggaagtcattattgaaaatgacgaccagttatatcggaccttcaaaaaaattgatactttgattcgacatacacaactggaagaggctcaggatgtgttccagcatatccgtccgaagcagttacgtagtaatacggataagaaacagtattattactatgagggctatcttcaattagtgctcaatgacaatgctgacgaagccatctttaactttgggatgttgcttaatcagttcgtcaagtctagtcacgatatgtttgccatcctggccacacttggaaccggcttagcttatgaacgtaagcaggcctatgacaaggctgaaatttttgtcaaacaggcagttgctaccttacacacaatggatgcgcaagcaatgccgatgggtgacgacgattacttacaaaatgaaattttgatttacgcctcagccgcacaattgtatgctaagatcaattttccagaggaagctttggagttgatcgacttggcactcaagaaggctcaggagagtcagtcactttatttattagaccgtttgtatgcacaaaaggcggccaatgaagttgttttaaataatgtccagtcagcgcatgatcactattacgtggcgtatgcgttaagtctggtgacacataacagtagtttgaccgaaaaaatcacgaaagaaatggccgagtaccatattgcacccttgcaagtggctaacgacgcttagataacgtgataggacagttagcggtgaacggccgcgcttaatgggagatattgcggttcccattaggcacggcacaccgctgactgtcctatttttaataccggggggaatgtgaagatgagttgtcaaaactgtggttaccaaaattcaccgcatgccgtgacttgcctaaaatgtggtcatcgtctaacgccagtgaatggtgatgtcaatcagcaaagccgagtccagcggcggcgtcaacaatcacggcggacaactttttcgagtcgctttaggccacaaacactccttggggtattaattgcggggttactattgctgggtggcggctatatcgtgggacaactattgtggtcgtctacaacatcggcaactgccgagtcggcaggtaaaagccaggtgcataagccggctgccagcgattctgacgcaccgatgaaggcaacacagacatttccgactacgacagttactgatctggttgcgcaagcaacgaatgggttggctggtcaaacttcggtagcggtgatgccattaacgggtagccagaccgtggttttgaataatcgagcgcaacgtgctggcagtttgatcactttatttattatggtcactgcctttgatcaggtccatcaaaataattggcgcatgcaggatcgttataccctgcgtgctgccgataaagttggtggaaccgggacgttgcacacgttaccagctggaagccagttgacgtatgctgaaatcacgaaacgcatgattacggagagtgataatacggctgctaatatcatgttggatcgtgttggcggcttctcggcggtcaacacggaaattgcacagttgggtctgactgatacaaaaatggctcggcggttaatggatactgccgcactaaaggccgggcatgataacgatacttcggttcgggatgtggcaacggtgctgaaacgactggcgaacctgcgtttgatctcgaacaaagccgatcacgcgatgttaacgattttgaaggcgaacacggatcacagtaagttggtcaaaaatctgccaacacgcgcgacgatctataacaaaactggggactatcaagcatacggtgttcaaaatgatgcggccatcgttcagaatcgtcagggaacttttatcatgacgatgatgactgctagtggggaacgtaccgcgcaaacggtcgcgatgaatgatcttggtcaggcgctttaccgggcaattttagagcagtaagcggtatgattttggcaaatagtaaaaaatcggccagtgaggtaagtaacttcactgagccgatttttattgtacgtgtatcaaaagattactttttctttggtttaggagctggcttattttccaagtcagtccggacaacgagaacgtcacaaacagccatccgagtgacatattcggtgactgacccgatcaataagcgttcaaccgcgttgagaccagttgcgccaatcataattaaatcgatgcccatatccttaggaacgtcgcgcgcaataatcgtcttaggtgcgccatattcaatcgaataatccacgttatctaagccgtccgccttagcttctgcaacgtacttgtccaacgttttttgagcagtatcggtcacttgttcaaccatggtcgtatcaaaactagaaatgttttggaaagcacgggtatcaaccacgtggaccatgtgaactgaggcgttaggtccgttccgtttcgcgacggcaaccgcctttttaaatgctaattccgcttcataagaaccatcaacaggaactaaaatgtgttggtattgttgtaacatcattctcacccctcattactttataactatattgtaaaggttttcgcaaaaaataaaaagcgttttctatgagatttgcatgaaactcactaaaattagtgcaattgccatcataatcagtgaaccgctagccagtacaatggcaattagcattgtcgcttgaacaaagatggtcacgaaacaggcgatggtaactagtaacattaagccgccaccatagcgtgcgacgtgtttgattgtcggcgctttgttcgggtcaaaaaagagaaatggtcgggactggtgcgtcagcagataataactgagccaacccgcaatgagcgtgtatatgacaagcagtaatgtaatcaaaatgaacctccaacaggtgatgttaatcttattttagttgattccggaagagaagacaaatgcaatgctagctaaagataagcgattagtactagtagttcacacaacacaatttagcgtcaaatgattgcgacacacgtcatgctggttttatgaggatgagtaattgttcaggagtgctggattgttgcagaaatacccaaaccagcgtgatggactgtatttcagtagccgagattagtcatgtataaccggcttcccaattaaccattctccccatgagttttggacggtgttagtaaaatgacgttgtgaacttgggtcgctttcacgccacaaaaaaaggccaggaacaagtcctgaccaacggaagtaaacttccggaaaaactagtggtgccgttaatcgcccttcagtattgacccgctttaaggcaggtgggacgttctgactaattcgctaactaccaaaggataaggcatgttatggaattagctaacggacatcccaaagtagtattaattgttcggcaacactttgtttagagcaatgcgcacaccttagtaatttcgactcttagtctagcatataaaaataaaagttgcaattattagcacaaccaaggtattgttagcgatttctctcgttagcctttaataatttttcgtattgttgcgcaagggctgtttcgtagcggccatttgttttgggctcgtaatacttggctgatttgatggcatctggtaaatactgttgagcgacccaatcacccgggtgatcgtgtggaaaatcgtatccaacaccatgaccgagtttggcagcgccttgataatgcgcatccttgatgtcggccgggatatcaccgaaatggccgtcacggaccgttgtgagcgcggcatcaatggcactgatccctgaatttgactttggcgataaggctaattcaatcacagcgtcagctagcggaatccgtgcttcaggaaatcccaattgatcggcagcttgaacagctgcgacggtgtgggcacatgcggctggattagctaatccaatatcctcataggcaatcaccatcagccgacgcataatactctttaaatcccccgcctcaactagccgggctaagtagtgtaatgcagcgtttacgtcggaaccgcgtatggacttttgaaaggccgagatcacgtcgtagtgggcgtcaccatctttatctgcggataaggctttcttttgcaagcattcttcaattgtttgttgtgaaatggcgatggtgccgtcatcggccggagacgatgataatacggccaattctaacccattgagggcactgcgcaaatccccgttggtagcggtgcacaggtggtgcatggccgcgggtgctaaatcaacgtggtaactgccaagaccgtttttttcgtcagcgagggctcgttccaccgcgtgctgaatatcatcgtcagtgagcgggaaaacttgaaagatctgcgttcgactacggatggctggattaatgctaatatatggattttcggtcgtagcaccaatcaaaatgatgcggccactttctaagtgaggcaataaaaagtcttgtttagttttatccaaccggtggatttcatccagcagaagaatgaccgtcccgctcattttggcttcttcggctacgatttgaagttgttttttactgtcggtagctgcattcagcatgcgaaaagcatacttggtggaaccggcaatggcactcgcgatactagtcttgccagtacctggtgggccgtatagaatcattgatgatagtcgtttggctttgaccatccgggcgatgatcttgcctgggccgaccaattgttgctggccgacaacgtctttcagcgtttttggtcgcatccggtaggctaatggttgttgcatcgtttgaaatccctccttgcaaaactagtcccaactattatagcatttacaatgaaggacaccgaataatcagtttaacgaacaaaataattataaaggattgatcattatggaattagatgccgttggtaaggcaattgtacagtatcacttagtcccactcgttcatcaggctaatttaggactagaggtcaccatgcaccgggtggacgaccatggtcacttagcgacgacagcacacccgcaagcgtttggatcagcgcaacaaaatcatcagttacgtccgggcttttccgcaagtgctttaaagtttactacgccggtgcgtcgtgacattcctgcattgatggcgtatctgaagggcttgaataccgcagcacggcggtcactcgatgcggacgaacgactttggccactgtcgagtacgcctgtgttgccggatgatctaacgaacgtgccactggctgatgttgatcaagtcagctatcagcgtcgtcgcgacttagctcgtaagtatgagttacagcgattaatgacgactggtagtcacgtgaatatgagcttgaatgaagctttattcacccgtttatatactgagactttccatcagcagtatcacagttatgttgactttcgcaatgcaatttatctgaaagtcgctcagggattggtgcgcatgaactggctgattcagtatttatttggcgcttcaccacgcctagccgttacggatactacgagtcgtccacagcgcagtagtgttcaacatcccgatggtcgctacagtcaagtgacgggagactatacgtcaattgatcgctacgtggccaagttgacggcggctgttcgtcaacagcagctgttgtcggtcaatgattttgacgggccagttcggtttcggagtaatgggcagctagctacgatggcccggcagggggtctattatcttgaataccggggcttggatctcgatccaactagtccagtcggggtggacgcgaacgcggtggcatttgttcgtttgttggcgagttatttcgtaatgatgccggcacttccagctaagatggtatcccaagtcaacgctcaagctgaccaattgacccgtcaagttttgggtgaaaatccaacgacggctagtgctcaggctgtaccggctgttcaagttttagatgcacttgctgattttgttaaaacctatggcctaccaaatgaagatgccgtgttactcaaacagttgaagtcgcgggtcactgatccaaagaagacgctgagtgcgcagattgccatgcaagccgatccgttagcatgggcactcgaacgggctgcacgctatcaggaatcgagcaatgaacgtccgtttgaacttgcgggctttaccgcgctagatctatcgagccagcaactagcccagcaggccttgacgcggggagtgcaggtggacgttgttgacccacacgctaacattttacgattgactaagttaggacggtcgcaattagttgtgaatgggagcggaacggatttaaatccacaggcgctaacgaccgtactgacacataaagcagcggccaaacaaattctggctgagcacggggttccggtgccggcttcacagacatatcatacagctaatcagttgattgctgattatgatcggtacgttcaagctggtgggatcgtattaaaagcggcggatgagtcgcacaaagtaattgtctttcggattatgcccgaacgcggactgtttgaacaagtcgtccggcaactattcgagcaaacgtccgcggtaatggccgaggaagtggtagtcgcatcaagttatcgctttttggttatcgatggtcgtgtgcaagcaatcgtcgaacgaattccagccaatattgttggtgatggtcgctcaacggtcaagacgttacttgatcgcaaaaatggtcgagcgttgcgcgggaccgcttttaagtggcctcaatcagcgctacagttaggaacgatcgaacggtatcgcctggactcatatcacttgaccttagattctgtggtcagccggggaactcagatcttattacgagaggatgcgacttttggtaacggggcggacgtgctagacgcgacggctgatatgcatcaatcctatgtgcaggcggtggaaaagttggtagcagacttacacttagcggtcgctggggtcgacgtgatgattcccaatctctatgccgaattagtgccagagcatcctgaaatggcggtatacttgggtattcatgcggcgccgtacttgtatccgcacttgttcccaatgtttggtactgcccaaccagtggcggggcagttgttggatgcattgtttaaaaatgaagattaagttgcgattgatttaagctgtaatcatacggaattataccgaaaaaatgagcttgacaaggtaatcttgttaagctcattttttatccctggaaaacgcatttggacatttttagataaaatttacgtttaaataaatacaacagaaaaatatgaaaacgataccaaaaaatgttgacaatcaaaatataagcttgtattatgatgaatgaagaaagtagttctattaaggagggcgtaaatggcaacgatttcagacgtcgcaaagttagcgggtttgtcagtctcaacagtttcacgggttatcaataacagtccacacgtatcaagtaaaaagagaaatcttgttaaagcagcaatgaccgaattgggttacgttccacggccggccgctcggcaactgcgcgggtctaaaacgaatacaattgcggttacaattccacgaatcgtgaatccgttctttgcatatttggtagatgctattgaacgggttttagatgagcaaggttatagtacgctgattgttcagacttttggtcgaccagaagaagaggtgacagcattaaatttattgaaaaatcaacaagttgatggtgtgattctttgctcaattgaaaactcatgggcagttattggagcatatcaaaaatatggaaagattgtcctagttaatgagtatctaaaagaaaaagatgtccccgttattcgttcgaatcaatataagggtttttatatggcaaccagttttttatatgatcaagggtatcgtaaaattgcctatgctactggccgtaagaatatcgtgattacagaacgtggagaggattttgattcggaccggtttgcaggttttcaagattcattaaatgagcatcaattacgtttcaatcggcagtggttattcactggcgctcatacttttgaagatggtcgtaaaatattacaacaaatattgacactgaatgtacgacccgatgtgttgattgcggggagtgatgaagttgccatgggtgttgttcaagaggcagaacgatgcaaaattaatgttcctagtgccattggagtattgggcgtggacgaccagccaatgtctgcgaatctaaaaatcccgttatcaactgtacaacaaccggttaaaagaatgggacaagcagctgccgaagtcatgttaaaacagatcagtggcacagaaacgtctactgaaacagtatttgagctaaaggttattaagagagcatcagcctaatgctctttttaaaataaataatttggtatcgataccaaaaatggaggaattaattatgtcagtaattttagcacgggtagaccaacgtttgattcatggattaattgttaatcaatgggcacaagcattacaagttaaacggtttatggtggttgatgatgaattaagtactaacgaggccattaaagcaagtatgcggatgtctaagccagccggaactgggatgtctattatcaatacggaaaaagctattactaacttcaacgctggtaagtatgataatcaacgggtatttgttttagtaaaagaacccgctacattgattaagcttattgaaggtggcgtcgaaattcctaaagttgatcttggtattctatttaatgaaagcggtcgcaaaccagttacgaagtttgttgccttagatgatgaggaacgtcgtgatttgcaaatattggaacagaaaaatgtccctttggtaatccagtacgtgccaactgatccagaagaaccttttaaagcgtagacgaggaggaactaataatgtcaggtattcaaatattacaagatattcttattgttttgttagcagggtatatgacgattgatcagaacggtcttgtgattatgtcttggttcccggtaattgtcggaacgattactggtttgattatgggagatttacccactgcgttaactattgctgggacatttcaattaatgatgttaggtgtcgccgctttaggtggtgcgtctgcgcctaattacggattggcaacaattgtcggtatttttattgctgtacgaactggatctgggattaagtcagcgattgctgttgggttaccagttggattattagcaatccagttagaagtcattgcacggatcatcgtcaatttcttagcgcataagatgttaggtgatgttcaaaagcatgattttcagaaaatgcgtcgtgaagcctggtggggtccggccttgttcagtttgcaaactgccttacctgcaattctaattgttttctggggcgccgatgttgtcaaatttattttgaacgttgtgcctagttgggttacaaacggactaactgttgctggcggtatgttacctgtagtcggagttggcatgctattacggtatatgccagtcaaaaagttcctcagttacattattgttggctttgtgctagcggcatatttgaagattgatgtcttgggtgttgccttaattggatttgctgcagcttattggtacttcttaagcgagtccaaaaaggtcagtcaagtagcaacaaatgccggtgtggttgaagatgaaggggacgattatgatgaataagcaaccaacaactaagattacgaaaaaagatcgtcggcgggccgcggtacgctataattttatggcttgcaatatctttaattatgaatcccaaatgggacctgcggtggcttgggcactggcaccagccttacgaaaaatttatgatgatgacgatgagtatcaagaagcattagaaaatcattttaattattataattcgacaactgtaatgtcttcgctgattttgggcgcttcattagccatggaagagcgtgatggtattaaggctaagacagcagttcaatcattgaagacaagtttaatgggaccgatggctggtgttggtgatacgcttgtctgggtattgtggccgacaattatgggatcgatttcagggtatatggccttacaaggaaacccattaggtgcaatcgtttggttgattgcaaacattgttttttggtttgtgaaacttaaaatgtttgatattggctttaccagtggtacgaagcttattacgtcattgggtgaacgactaaatatttttacagaatctgcctcaattgtcggactaagtgttgttggcgctctggttgcaacggtggttaaaatttcaatgcctgttaaatttgcggtaggtaaagtaacgcttaatcttcaaaccggaatttttgataaaatcatgcctgcattgttgccggcattactgactttattaatttatcatttgttaggcaataagaaatggacaccaacaaaaataatcttactagttattgcaatatcactggtaggaacatttttaggcatctttaaggcataggggagagttgtgaattatgaaacgtaaaattattttagcatcacatcatcaatttgctagtgggctggctgacaccgttaattttatttctaataatgcagctgatattgttgctttaacggcatacatggataaccagccagtagaacaacaagttaaatcattaatggctagtattcctgcagaagtggagatcgttattttgacagatatgctggcgggcagtgtaaatcagcaattttttaattatcgaatgcgcccccacacacaaattattagtggcatgaatcttccgttagcgttggccattgcactagaaccgactgatcacgagttaacagatcagcgggtttgcgatttaatcacccaggctcaagaatcaattgtttcagttaatcaaatgagtatagaaatggatgatgatgatgaataaaacagagtggtggcggaagagtgttgtttatcaaatctatccgaaaagctttaatgacagtaatggcgatggaattggcgatataagaggtatcattgaaaagttagattatttgaagcaacttggtgtggacgttatttggctgaatcctatctatcaatctccacaagttgataatggttatgatattagcaattaccgagaaattgaccatcagttcggaacgttagcggacttcactgcattactagatgcagtacatcagcgacatatgcgattaattttggatttagtcgtcaatcacacatcaagtgaacatccgtggttcaaggcggctaagcaaagtacaagcaatcaatatcatgattattacatttggaaagatgggagtaaagaacagttgcctaacaactggggttcctcatttggcggctcagcttgggaatatgttgatcaactcggtcaatactatttacatttgtttgcaaagcaacagcctgatttaaattgggaaaaccctaaagtacgtcaggatgtatatgaaattatgcgtttttggttgaacaaaggcgttgatggttttcggatggatgtcatcagtctgttgtcgaaaaaaccaacttatccggatggtccggtcattcaaaataaagcgtatggcagttattattatggtgcagccaatgggcctaaaatccatgattatttacgtgagatgaatcagcaagtattaagtcattatgacattatgactgttggcgagacaccccatactagtgttgctgaggctgaaaaatatacggatgaacgacgtaaagaattaaacatggttttccactttgaccatatgcatttagattatgatgaaaatggtaagttttctacgagacgcttcaaattatccgcactaaaacaagtgtttaataagtggcaattaggcatggctgaacatcatggctggaatagcttgtattggagcaatcatgatcaagcacgtccggtaactcggtttggtgtcgatgatactgagtaccgagttaaatctgcgaagctgttggcgactgtgttacattttcaacaaggaacaccgtttatttatcaaggtgaagaactaggaatgacaaatgccaagttcacctcaattgatgactatcaagatattgaaacacataatatctatcaagactttattaatcataaacatctcagcaaagagtacacaatgaaagccatttatttgaagtcacgggataatgcgcggaccccgatgcagtggaccagcaaacataatgccggttttacaacgggaacgccatggcttagcgtcaatcctaactatactagaattaatgtggaacaagcgttaaaggataaagactcaattttctattattatcagcaactgatcaagttgcgtcattctttatcgattgtgacaacgggtgactttgagttgcttgatcccgacaatgaacaagtattttcatacttaagacgagatcagaagcagatactattagtcgccgggaattttaccgaaaaaccaaaaaaaattgttttgccaacagaactgcagaatagaccatgtgagaagatcattagtaatgatcaaaacattgcagaagagactaacagtgttgttttaccagcatatggtgctgttgcttatttgttcagtattgattaaatttaacagaggctaacagtgcaacaatcgagttgtccagtgttagccttttattttatataaaggattatagtcaatacacggtgtcgtgattgaaaacacctatttcgaattttatctaaatatctcttgttgaattcctggttgcctgttatactctatttagatatatatctaaataggtgattggaggtagcccgtatggcgttgaatacgacctttaaagcaattgcagatcctgtcagacgccagattttggaagatttacgccagaatcggcaatcggctggtgagattgcggctcatttcaagttaagcaatgcaacggtgtcttatcatctcaagcttttgaagcaagctggtttagttaccgtgaccaaggaaaaaaattatgtgtactatgagctaaatgcgagcgtatttgaggaaatgttgacgtggctatatcgttttagtccaaagcagggggatgaaaagtgatgacaaaaaggaacttgcagttgtggctgagctatattgttattctgttaccaatgagctacggcgtcgtgaattatgcggccttgcccgccaaaatggctattcattttaatttggataatcaacctaatggaatggccacaaaattattagtggtcgttggctttccaattatgatgatggcgtttcagctgatttgcgttggggtgacacggttgaatgccaatcataaggcaccggcgccacggtttgaacagatgatcatttggatcgtgcctgtactatcaagtgtgatctatgcgacaactatcagttataacttaggccatcaattggatatttggcgtattgccgttagtttgattgcctttattttcatggccatcgggaattatttgccaacaatcagtgcaaatcaatacgcgcagatgcaccgaggtggtcacacgattcggccaatgatttggcggcgtgttcgttattggttgggctatacgctagttggtggtgggatattgttactactgagtatcgtcacaacagcatgggtttcagtcagcctcatggggatcattgttgcggccttagttatcatgagtctttatggcactctagcgcgtaattaacgcagtcaaacgtaaaaaggtcctcatccgtgcgtggatggggacctttgttgtattaaagtaactttttgaatttatctagcaacccaggtgttttctcggcctggggtgttgctgatgaagtctgcgagggataacgctgcgcaacatcaataatatcttggttaatggcgcttgcagcagtgaagataagcgcgtaatcatcatcagcagtatggtagatgtcatccgttttgatagtgaatttgatattggcttgactagccgccttgatatacggcccaatcagttcctggtctaaattaccattaatatataattggtcatccggatggctcgtaaatgcttgatgaagtgagtcgacgtaattggcctgtttaatttgggcaacggtcactgcgacttcgacgcgttcccgaaaggtccccaggtacttgcgttgttcgtcgggatgcaactttggcgtcccgtgcatggccgtttcgatgcggtcaactggttgtttatctgtttcagccattgtctaacatcctttccttgatagtaattatcattgtagcatgttcctccaataatagcgaagggaaggggggtagcgttgcgttagtgaatgcggtatggttaatctaaattagttttggggatgataaaacttgtttacaaatcaagattttgaaatttttaatgaccagacgttagcgggccgcatgcatttaatcaaaacggtgatcgatcctaagttcgaacaggtcgcaccaacgattatagcgagtttacaaacacctagcgagccaccgttctacgcgcacgttgccaaacatttacggcgatttaagaatccaccggtagacacttgggtcgcttttagtcaaaacaaacggagctacaaagcctggccacattttgaattggggctatggcctgaccgtttgtttatctattttgatattttggatgagtgtaaaccggccgtgcaggcaaagatgcaactcgcagatttaacaccacttttgaaggccttgccggcgggctatgttatcagtaataatcatggggtgccggccacgcaacttgcaacaccggccaatattacgcaggccatcaagaaattcgatcagtataaacacagcgagttggtcgtgggccgcgcagtcttggtcggtgatccgttatttgaagatgctgatacgttgaataaattgatcatcacaacattcaaacaattattgtcgatttatcaaccggtcatggcggctgtgagtgctgagcgtcaggtctgaaattaacagaacatacaaaaaaaccgccgcaaacgcgacggtttttaaataccggaaattaaagtttgttgtagtattcaacgattaatgattcgtcgatatctgcttcaagttcttcacgttctggtaaacgagttaatgagccttcaagcttatcagcatcgaattgaacgaagttagggcgtgcaacaacggcttcaacagcaccagtgataacagccaacttcttggacttttcacgaactgagacaacttggccgacactaacttcgtatgaagggatgtcaacacgcttgccatcaacagtgatgtgaccatggtttactaattgacgagcttggcgacgagttgttgctaagcctaaacggtaaaccatgttatccaaacgacgttcgagtaagatcatgaagttaacaccatgcttaccttcgcgaatcttaccagctttgatgaataagttagcgaattgacgttcagttaaaccgtacatcatccgtaacttttgcttttcacgtaattgtgtaccgtattcagaaagcttaccgcgacgaccttggccatgatcaccaggtgcgtaaggacgacgagctaattctttaccagtacctgaaagggacattcccaaacgacgggaaattttccaacttggacctgtataacgagacataaaatgtttcctccaataattttagttggagtaaaataatccgatgtaagttcgatattcgttcagattggactgcaggtttcaccattgcagccgcaggttactaactgaccaaaatattggcaccaatctgttgacgagcttacccactcactgctgcattattttacacaaagagtagcataacacgtttaatactgattagtcaatgtgtgacgtcagaatcgccacaaattcggtcaattcagcttcgttatcagcattgaatcggtctaatgatggagagtcgacgtcgagtacgccgatttggtggccgtccttggtgattgggaccacgatctcagagttgctggcgctgtcacaagcgatgtggccggggaattgatggacatcggctacccgttggttcgtttgcgtttcaaaagcagttccgacgacaccagccccaactttgatgtgcatgcaagcgactttgccttggaagggacctaagtcgagctcgccagtttgttcgttaaataagtaaaagccggcccagttaaggtggtcataagtactgttgaggagggcactagcattagctaagttcgcgaccaggttagtttcttgaaacagtagggcgtcgagttgttggttcataagtgatgtttccgtggtagccatgtaaaaaatcctccttgaatgttaacaaattgttactgtccgttagttacgtctatgttataatttaagatagattttaattggattttcagaaaaaagcaaggttacggttctcaacagggtgaggcgcaacgcaattaaaacggaataaataatgtaaggggtattcgtatgcaagtagcaatcggcattgttgtggttgcgattgtcatctacgcggcggtcaaaggctttcaattttatatcgacaagcaagtccgtcaattgacggaacggcaacaggcgctagtcaagcaatcgcagaccacagatttcgaaaaaattgaacaactcggactaacgggcggatcgttagcgaagttggaagcgttgcagagcgctggtcaagaagttgataatgatcagttacccgccgttagtgagcaattaacggccattacttcgcaggcgcggggcatcagatttctcgatgctcagcagaatctgaagaaggttgcggccacattagatacgattgaacaacgacaggcagaaattcgtcagggcttgcaggccttagatgacgcggatgccgcgcaccgccaagcagtggctagtttagagaagaagtaccaaaacatacggaagacgttattatcgcaaaacttttcatttggtccgagcatcgacaaattggaggatcagttagctaacttagaaagtgattttgatcatttttccgaattagccaaggctggcgatcatgacgcggctgaaaaggttttggatcagttacatcacgatactggcactcttgaaatggatattgatcggattccaccgatttataaggacctagtgagtgggtttcctgatcagttagccgaactggctagtggttatcaacaattaacggctcaacattttcactttgaggtcgaatcgattgagccagaaatcaaagcgttacagcaagcaatcgacgataatattgcgttacttggtgatttgaaagttacggatgctgaaaacggcaatcatgcgattgaaaagcggatcgaccacttatacgacgtgatgcaagcagagatcgatgctaaggccgttgttgatcaacaacaagaagaaatcagtaagttcttgacacatgccatgaatcagaatcaccgcttacaaattgagttggatcgattagcacaaagctatacgttgaataatggcgaagttgaacggacgcgtgaattgaacgaacaactgaagaatatcgaagctgtttatcaggcggacgtcacagctattactagtaagcaagctgtctttagtgagatcgcagctcattttgccgaacaagatgagcagttgaaaggcattgaagaagaacaagtggcaattaacaaaggtgtggcgagtttgaccgctgaagagtccaaagcccacgagacgttgcaacggttcgattttgaaatccacgcgatcaaacgccaggttgaaaatttgaacttgcctggactaccgaaagactatttggactatttcaaagtagttgccaaggaaatcgaacggcttgaccatgatattaataagcttgtgatcaatatggacgacatcacgaaacagttgattgtcattcaagcggatatggcgaccttaaaggaaaagaccagtgatttaacggatgctgcggttatggcggaacagctcttacaatacgctaaccgttacaagacgaatcatgaagaggtgcaagaagccagcgtggaagcacaacggttgtttaccgagactcatgactacgcgcggagtttagaagtaattgcaacagctgtggataaggttgatccggggtcctataaacggattgaggacagttactatgcgaataaacaagctgacaagatgaacgatgaggcctgacgaggatagttgggaccgtccgtatgcacaattttagttagctgaaaataaccagctggtggtgattgttaaatgacaaccgccaccagctggtttttagttggcatcatgatgcaagtggtcgtgatggatctaagaagggtgactgcgaacggccaacaaaaatggtgtttaggacgcaattgtcgtgtgattaatcaggaatttgaaacaaaaacccttgtttcactagtaatatttggtataattgcaaagaattcttatcgaaagtaagtgcaatgcacactttcttggaaagagaaggcgtagtaatgatttattttgacaatagtgcgacaacgcaagctgctcctgccgtactggagacgtatacaacggtttcccaaaaaatttggggtaatccgtctagtttgcataactttggtgaaacggcctttcatttgttggaacaatcacgtcaacaaattgccggcttactaggtgtgcaagcccacgaaattttcttcacgtctggtgggacggaaggcgataattgggttttgaagggtacagcgattgaaaagcgggcctttgggaagcatctaattaccacggcggtggaacatcctgccattcataattcgatggaacaattgaaggaacttggttatgaagtgacttacttaccggtcgatcaggaaggccgtatcaacgtggcggacttgaaagcggcaattcggcctgacacggttttagtgtcaacgatggcagtcaataatgaaatcggtacgattcagcctttacttgaagtggcggaactactgaaacaatatccgaaaattcattttcatattgatgcagtccaaggaattggtaaaggaatccagaacatgatcatgaatgaccgggtggattttgtgaccttttcagggcacaagtttcatgcgactcgcggggttggctttatttacgcgcgcaatggtcgtaagttagcgccattaatgaatggcggcggtcaggaaagtaactggcgttctggaactgagaacttaccagcaattgccggcatggcgaaggccctgcgattgttgctcacggatgaagatggtaaggtagctcgtgagcgagctatcaaacagcgaatctacgagcacattaagtcgtttcctaaagtgacgattttcagtcagccaacgacggggttcgcaccccacatactgtgttttacgatcaacggtgtgcggggcgagaccattgttcacgcgtttgaagatcagggcatttatatctcaacaacgagtgcctgctcatcgaagaaacacttggcctccagtactttaatggcgatgcacgtgcaagaaaacattgcgacgagtgctgtgcgggtcagcctcgatgagaataatacgctggcagaagctgaccagtttattaaagtatttgatcaactttatcaaaaattctcaaaaattaatgcagacgcataacggaaaggaacttgttcatgcagtacactgaaatcatggtacgttatggtgaactatcgaccaagggtaaaaaccggcggaactttatcgatagcttaggccgtaacgtacgcaaagcgttgcacgactttccagaactaaaggtccacgcgaaccgtgaccggatgcacatcatgttaaatggtgaggatgccgataaagtcatgggccgtttgaagctagtttttggaattcaaaacttttcaccaagtattcgcgtcgatgccgacatggatgccgtctatgaaacggcgattgcgatggtcaaagcccagtttaaaccggggatgacttttaaaatttacacacggcgctccgatcatcagtttgaatacgatacaaatcaaatcaatgacatgctcggtgggcaaatcttggaccacgttgacgggattcaagttaagatgaagaatccggacattgtgttacgtgttgaagttcggttaaacggtatcttcttatcatcagaaacgattcagggtgccgggggattaccggtcggcaccgctggcaagggaatgctgatgctttctggtgggattgattcaccagttgccggctaccttggcatgaagcgtggtgtggacatggaaatggtccatttcttcagtccgccatacacgagtgaacaggcgttagcaaaggccaagcagttagcgtcaacgctagcaagttactctggtagcgtgaagtttattcagattccattcactgagattcaagaagaaatcaaagaaaaagtgcccgagggttatcttatgaccgttcaacggcgcctaatgatgcgtttgatggacgccattacgcgtcaacggcatggtaaggcgatttttaatggtgaatcattagggcaagtggcttcacaaacgatggatagcatgattgccatcaatgatgtgaccaccttgccggttttgcgcccagtgatttccatggacaagacggaaattattaagattgccgaagatattgatacctatgacttgtcgatcatgccatttgaagattgttgtacgatttttgcgccgccagcacccaagacgcatccgaagctagaccgttcacggtcctacgaagaacggattgatgttgaaggactgatggcacgcgctttggctggtgttaaaatgactgagatcaagccgggtgaaaattatttgaatacacaagaagacgtttttgctgaactattgtaggtcaaaaacgggtgatattattaccctaaaaacgagtacccggtaatactgggtactcgtttttttgatcttttggatgatcaagcagggacgcgcggaagctcatttcgtaatggtaagtcagctaaataataggtcataatcagcgaaccaaggtcgtgactatgctacgataaatttagattgaatcagcgaggtgagtggatggagtggcaacaattattaatggaaaatacggcgttgatcaatgcacaggttgttcagattgggctggaacgggaaggccagcgggtaacggtgaccggtcatttggcggatacggcattatcaccaacacttatcagcgagttgtccggcctgcaacgggactttgcggagacacagttggagttagtcacccaaccgcaagcaagtgcggttgctgcgttgcacgccttaacgatgctcacacaacaagtccggcaaaggcttctgcctgaactgatttggccgctaagcatgccgcccacacttccacgagaagaccgggatattccaattgctaagttggatgcggccgctgtcgcctatcgacaaggacttgctcaccgctatggccgacgacgtcaaatgttgtcaggtgttcactgtaatgtgagcttggcggctagtctgatgatgggattgtatcaggcccagacagatagtcgtgatttcaccacctttcaaaatcactgttacctgcacattgcgcagaattatttgcactatcgctggctactgacgtatctttatggctgctcaccacgctgctggccacagtctggtcttacgccaccagcccagcccgttcgaagcttacgcaacagttctagcgggtataccaatcggccgggtgttacggtctcgtacgcgtcgttaaatgattattgtcaaacactgcaagcggccgttgataatggaaaattaagtgcgaccaaggaattttacggtcaggttcggttgcgtcatgctggtggtcattcacaactatgtcaggatgggattcaatacttggaattacgtaacttagatctgaacccatgggccggtgcgggcatcgatctgtcccaactgacctgcttaacgtggttcgttttactgatgctctggttaccagtgccagctagtacggataattggattcaggcgggtcagcgcgccaacgaacaagttgccatcgaaacccccatgcaagtgactcgacagctaactgaaggcgaacaactagctgacgcgctacaaactatggctaccagtttacatcaaccacacgcgttgcaagtcgcccaacatatcttaactagtctgcacgacccggccaacacactcgctgcccgctgggaacaacaaacaaacgattcgctcgaacgtgcaacccaacttgcactccagctggctacgacaccacattttaatgcttgaatatactgaaatcggcgtacacacatgttggcacgttaggatgcgcatcggctgacgaacagcaaaccaactaataagcacgtttaaaccatgactaacgtcaaataacgcatcgcatgtcaagaatgataatttttgagacgattatttgcgcggaaactgaaattgcgttaaatttgagctatactattactaccacaaatattagaaaaccattagttatcgaaggggtgttttacgtgcaagtattatttcatgatcaagcgttagacttagtcggtgaaccgttacaagatggtgaccagttaccgaagttcaaagtgttcactacccatgatgaaaagattaagactaaggacttgctaggtaagcctgtcttgttaagtgtgatgccagatattgatacgcgagtttgttctattcaaacaaagaagttcaatcaacaggctgataagtacccccacgttcaatttttagccatttccaataacgcggttgctgaccaagctggttggtgcgctaaggaaggcgttaagaacttaacggtggcttccgatgaagaactatcctttggttacgccaccaatctatacttgcccaacaatgggacgttgacccgggcgatttatgtcgctgatgcggccggtaaaatcgtttatcatgaaatcgtgccagatgttagtcacgagccaaattacgttgcggcactggatgccctaaaacaattcgaataaggattgacggcactcaggaaattcattacaatagtgacaaccagcaatgagcaagagagtagcgataaacaacgtcaacagagagagcgtgaacagtgaaacacgcttggcggttttagcgtgaaggtagcttgcgagctgctattctgaactgttttagtaggaatagccggacgggatacaccgttcgttaacaacgatgtttaagttgtaaagcgatcacttgtgatggctttaaaattaggtggtaccgcgaagtccattcgtcctagtctaataggatgagtggacttttttagtgccaaaagaaaggatgtgccccaatgtcagaagaaccaactactgatatgccaactaagtatgatccgaccgccgtggaagcgggtcgttatcagacttggttagaccaagatttatttaagccttcgggcgacaagaaagctaaaccctattcaatcgtgattccaccgccaaatgtcacgggtaagttgcatttaggccacgcttgggataccacgttacaagatattattattcgtcagaaacgaatgcaaggttttgatactttatggttaccaggaatggatcatgccggcattgccacgcaggcaaaggttgaggccaaactgcgcgagcaagggatcagccgttacgatcttggtcgtgagaagtttattcaacaagtttgggattggaaagacgaatacgcgtcgattatcaaacaacagtgggctaagatgggattgtcattggactattctcgtgaacggttcaccatggatgatggcctgtcagatgcggttaagaaagtcttcgttgatctttacaacaagggcttgatttatcgtggtgaatacatcatcaactgggatcctcaagcacggacggctttgtctgatatcgaagtgattcataaggatgacaagggtgcgttctaccacgtcaagtacccatttgctgacaaagactatactttcaatggtaaacattacattgaaattgccacgactcgtcctgaaaccatgatgggcgataccgccgttgcggttaatccgagtgatgaccgttacaaggaattggttggcaaaaaagtcatcttgccattagcagaacgtgaaattccaattatcgccgatgcgtacgttgaccctgagtttggaactggaatggtgaaaatcacgcctgctcatgacccgaatgactttaaagtcggcaaccggcatgatttgaaacggattaacaccatgaatgatgatgcttcaatgaacgccaatgcgggtaaatacgaaggtatggaccgttttgaagcacgtaaagcgatggtcaaggatcttgaagatcaagatttgatgattaaaatcgacccaattgtgcatagcgttgggcattctgaacggactgatgtccaagttgaagcgcggctctcaacccagtggtttgtaaagatgaagccacttgccgaacaagctttgaagaatcaagagggtgacgatgccgttgactttattcctaagcggtttgaagatgcctttaagcagtggatggaaaacatccatgattgggttatttcacgccagctctggtggggacatcggattccagcttggtataacaagacgaccggtgaaacgtatgtcggtgttgatggaccaaaagatccagaaaactgggaacaggatccagacgtgttggatacttggttctcaagtgcactttggccattttcaacaatgggctggccaaacactgatgcggaagactttaagcgctatttcccaacgaataccttagtgactggctatgatattttgccattctgggtttcaaggatgattttccaaagtcttgaatttacaggaaggcgaccattcaagaatgttcttttacatggcctgattcgtgatgaacatggtgttaaaatgagcaaatcactcggtaacgggattgatccaatggatgtgattgaaaagtacggggccgatgcattacggtggttcttatctaacgggtcgacggccggccaagatgtgcggttcagctatacaaagatggatgctgcatggaactttattaacaagatttggaacgccagccgttacgttatcatgaacctgggcaccatggacaaaccggaattaccagctgcaagtgactggacgttagcagataagtggatcttgagtcgtttgaacgcgacggtcaaacaagtgacgactacctttgataagtttgactttggtgaagctggtcgagccttgtacaactttatctggaatgacttctgtgactggtatatcgaaatgagtaaggaagtcttgaccggtgatgacgctcaagccaaggccaatacccaaaacgtgttagcctatgtcttggatcaaatcttacggttattgcacccaatcatgccatttgtgaccgaaaagatttggttatcaatgccacacgttggtgaatccttagtagtcgctgcttatcctgttgaccatcctgaatttgatgacgaaacggcggaaagtgatatggcctcacttattgaattgattacggccgttcggagtattcgagcagaagctaatgcgaagatgtcatcagccgtggatctattaattaagacggacaacactcggttacaagctgttttcaaagctaatgaagattatattcaacggtttgcacatccgaagacactgtcaattggcgccgacgtggttgcaccgaagttagccatgacacaagtgattagtgatgcggaagtttacattccgttagctgaacttgttgacctcgatgaagaagtcaaaaaacttgaaaaagaacaagccaagtttgaaagcgaagtcgcacgggcgacgaagaagttaggtaacgaacgctttgttgccaatgcccctgaagacgtcgttaatagtgaaaaagagaagttagcggacaatcagacaaaactagctgccttaaagcaacgtttagttgatattaaggctgaagcttaatttgcgataatagttaactgaaatgtgtgttactggtaaaatggtaatcgtcccgttttgggatggttaccattttattattaaaacgtaaaatataagggctcattagctagaagtatggtgagcaaacggccaaatgatgattcgcgcggtttacaggaaggaagaccaacatgattgacacttattcagcagcattagcctttattcacggccggactcagttcaaaaaagccccgacactcagtcgtatgcgccaattcttacatgaattgggtgatccacagttaaaggtggccggcattcacgtggcggggaccaatggcaaggggtcgacggttgcgaatttacgcgaattatttatggcagatgggctaacggtgggaactttcacgtcgccgttcattgttcgcttcaatgaacggatcagtgttgacggcacccccatcagcgatgaagaacttgttggtctggtgcaacagattcaaccgatcgttgccaagcttgacgcgacattggcaagtgggggccccacagaatttgagatcattaccgcaatgatgtttctttactttgctgctcagccaatcgatattgccattattgaagttgggttgggtgggttatacgattctaccaatgtttggacaccagccgttagtgtgattactacgatcggttatgatcatatgcaaattctaggtaatacattgacggcgattgcgactcaaaaagcaggtatcattaagacgcaggtgccggtaattgttggtaaattaccggctgaagcacagcaagtgatgattgataccgccatgagcaaacgggcgccgttgcggacgttgggagttgattttacaaccaaattattaccgccccaaggctggcaagaacggtttaactttgacgggttagaggcgcattttaaagacttgacaactccgctactgggagactatcaagttgataatgcggccgttgcaatagcggcgtacctaacttaccaccaagcgactcagctacccgtggtcactagcgacgtcaaagcggctgtggcagcaacacaatggcctggccgtttcgaacgcttgaatcaggacccactgatcatgattgacggtgcgcacaatgagccggcagtaactgaattagcagctactttgagtgagcgatttggacagcaaaccgtttatgtcatctttgcggtcttagcggataagcagcatcaacaaatgattcagaccttgggcgcattacctaatgttcaattacggttgacacaattcgaaggcccgaacgcaaaacgtccagcgaccgacccgacgatgttggcacatgaaatgccaaatggccggaccgctgaagtatttgataattggcaagctgccttgatgcagacactccaagaaatgtcgagtgatgatgcgttactactaacggggtcgctgtactttattagtgacgtacgggcttatttcaaggatggcagcgactcagaaactgattaggggctgacacggatgcttagaagacaattgcgcaagaaataatactgcgtccctggtactgatattatcaaagatgattgtgagttaactgaaaaaattgcgttaaaatgtcggtgaattaatggttagccggtcactttacgaaactactaggtagaaagggtggtttcaatgacgatgatcagcgaagaacaaataccgacagcacaagttcgtgaattaatgcaagcctactttgggacgtttttacccaacgacgcggtgactagcgcgatgcaggcctttgagcgtgagtacccgatagaggacgctatagagtggttacatgagtcgtctgaaaatccgcgctggcaaggtttaatcgtggcgctcagatgtgggcaactattaccccggccaagtcgattaattttggggcaggtatatggtagtgaacaactgggagccgttttagcacgggactttgccaacttagagcaggaacagttgcaattgttatgcttagatacgaaaaatcaagtgatcaaacgccaggtcgtctttcagggcacgctcaatagttgtccggctcaaccgcgggaaattattaaagttgccctaacgacaccgactgcccgggtcgttattgcacataatcatccgagtggtgatgtgacgccgtcaaaaaaagacgttgaatttaccaagcggttacaactggcttgtgaactgatggggttaccgctcttggatagctttattatcggtgtaaacgattactttagttttgccgagcagggcgtgttaaattgtaatacggattcgtaacagaatgtggtaaaataacggggttaggaccgataatttaatcggcctgatcgcgtttttttgttaaattttatctaagttaaatagtgggactgtatttttcattaatttacggtatgctaggactcaggcaatgcttttttaatgcagtgcgactatgctataatacttactattatgactaaataaaaaattaaatttgttaatgatgaagggatgaatgtagtgttcggatttgggacaaagaatatcgggatcgatctcggtacggccaacacaattgtgtacgttgacggcaagggcatcgtattacgtgaaccatccgtagttgcgaagaacacgaaaactggtgaaattgtatcagttggttcagaagcacgggatatgattgggagaaccccagcaagcattgtggcgattcggccaatgaaggatggcgttattgcggactacgatacgaccgttgcgatgatgaagtactttattcaaaagacactcggccgctcaaatggtaagccatacgtcatggtttgtgtaccaagtggggttaccgaagttgaaaagcgggccgttattgatgcaacacgggttgcaggtgcgcgggatgcatatgtcattgaagaaccatttgcagccgctattggtgcagggcttccagtcatggatccaactgggagcatggtcgttgatattggtggtgggactaccgatgttgcgacaatttccttaggtggaatcgtatcaagtcgttcaattcgaatggctggcgataagatcgatgactcaatcatttaccatgttcgccagaagtttaatcttttaattggtgaacgcacagccgaacaacttaaaatcgactgtggctcagcttctttggaagccgctgaagacttggaagggtcaacgattcgtggacgagatcttttgtcgggcttaccaaagacggttgaaatctcatctgtagatgtttcagaagccatccaagaagtggtctctgaaattatttcagccattaaagaaacccttgaagaaacttccccagaaattgcctctgacgtaattgaccacgggattgttttgaccggtggtggtgccttattgaagaatctttccgaagtgattgcggacgaaaccaaagtaccggttttcatcgctaacgaaccgcttgactgtgttgcagttgggaccggtgaatcactcaagagcatcgacgttatgaaaaagcgataacaggtgagcgggaagacgtcttcccgcttatttattgttaaatcattgaattttcgaccgggggttcattatgcaaaagtttttttctaaccgaaaactagtgattgcgattgtcgtgttcattattagtttcggcttgatgagtgtctcagtagccattcgtgataagaaatcgacaccaccattgatccaacaattcggaaacgatgtggctggtgcggttgaccgggtgattgcttggccagtcaatggcttacaaagtgcgaccaactcagtttctgacttgttgaacacctatcaagaaaatcaaaaattgaagaagcaagttgaccaactggcgcaggccaaggttagtgcccagacgacgcgtgcggaaaacaagcagttacgcaagcagttgaaattaaataattcgttatctgattatacgacggtgaccgccaatgttttgacgcggacaccatcatcttggatgaaccaactcgtgatctctaagggtgcgacatccggtgtaaagaagaatatgcctgtcatgtcacaaaagggtttaattggccgggtcgtggaagttaaccaaacgaattctaaggttgaattaatttctaatacgagttcgtcttcgaataagtttgctattcagattacgaatagtgctggtaagactgttaacgggattatttcaggttatgataagagcaataatcttttagagatgggttccgtgacgtctaacgttaaaatcaaaaaaggcgataaagtcgtgacgagtggtttaggcggcaatacgccgaagggactttatgtcggcacggttgctagtgtcaagcaggatgattacgggctagcatccgaagtggaaatcacacccgcagcggaccttagtgacttaacagttgtgacggtcgctgaacaatagggaggtgcaacggtgcgttactcaagattaaaaatcatctttccaattgggttatttgttgcactctttttagacggctcggtgtcaaatgtttttgccggtaaactatttagttacccgtacgccagtgtcttacacctagttttactgtggattgtcttcgctgtctttttagatgaccgtgataatctgtcggttggaatttggtctgcattcgtgggcttggtgtttgactggtactatactgggattttaggcgtttacatgattggcttaccgttggtagtctatatatgtcgacaaatcaagccatggatcgacctgaactttttaacgttactgatgatctatattattaatttgaccattttggaagcatttacgtatatttggtacacgatgagccatgtgatctctagtgggttagcagactttgcggtgtacacgctaggaccgacgattgcggtcaacctagccatctttgtcatattatattatccaatgcgtcggttatatctgagtgttaattagtcggcagaaaggaattctaacatgcaacagagtgtagttttaaaggccagtaatgacggctatgaactgattttacggcaagaagcaagtttcgatgatattatggtcgacttgaaggtcttgttggatcggttgcaggctgataatacgactgataaacaaatctcgtttgacctggatacggctagtcgactactgactgcggaacaaaatcaaaaagtgacacagttgattcaacgatatccgttattcagtattcataagctaacggcagatgttattttgacggcggatgctttagcgatgattgaacgtgatacggtgcatctggttaatcagattattcgcaacggtcaggtcgttgagattacgggggacgtgttgttcttcggtaagatccatgaaggtggggtgctccgggcgacgggtagtatctttgtgatgggtgaggtaaacggtgcgcttgaggccggttatcccgatcacaatgatgcggtgatcgttagccccttagcgaccgtcccgcgggttcgagtcggtgaattgttagaattagtggaccttgaaaaagttgttgatgggacgaacgtcgtctatattaatgacattcaagcgttggactaccagccgctccagcaattaaaacgggtacgaccgaagctatttactcgaaatggaggacgtgtttgatgggaaaagcaattgtcatcacctctggtaagggtggggtcggcaaaacgaccactacggccaatttagggacggcccttgctttgatgggcaagaaagtttgcttagttgatttagatattggattgcggaatttagacgttattttgggtctcgataaccggatcctttatgatattgtggatgtagttgccggtcgtgctcaaatacggcaggcgttggtcaaagacaagcggtttgatgacttattgtttttattgccagctgcacaaaatgcggacaaggatgcattgaatcctgaccaagttcgggcaatcgtagacgagttgaaaccagattttgattacgttttgctcgactgtcccgccggaattgaacaaggtttcatgaatgcgattgctggtgcggatgcggctattatcgtctcgacacccgagatttcagcaattcgtgatgcggatcgggtcgttggcttattggaacaatatccgttagccgaagcacctaagttagtgattaatcgaatccggacgcgcatgatgcaagatggtgagacgatggatattgatgaaattacgcatcacttatcgatcgacttgctaggaatcgttttcgatgacgatgccgtcattcggacttcaaataacggtgaaccgatcgttcttgatcctaagaatccagcctcacaaggctaccgcaacattgcccgccgaatcgaaggtgaaacggtgccattaatgaatttagatacacctaaaccgggtgtttggtcacgaatcgccggaatttttcatcgtggcaagtaaaaaaggcttgacggttgattaattttcgattagtatgaactcaacattaaaaaacagggaacagaagagtagttgtaaggaccttgccgagcgagttatcgatgatgggaagatgaccaaggattacaacgaaccacatctgtgagttggacagctgaagttagtaagctgtttcggttggcctcgttagcggcggagtttagtgataaactcgttgagattagttgtgtgagcaactagtgaatatgaggtggaaccgcgattaaatcgtcctcttaggcatgctggcctaaggacgatttttttattatcacaaaactccctgaggtaataactgtgaagttattacgaagtgaggtggcaccacggataaccgtcctcttgagtattcgactcaaggggacttttttgtgtacttgagtcgtgaccgattagtggacgcaggacaatgtgacctgtaaatttgggagggaaagtacatgcagtatattttagaaattttgccatcattattatccggtgccgttatgacactgaaaattttcatttggaccctgattgggtcgctaccattggggttagttgttggtctgggattaatgtctaacttcaaaccgctgcaatggttattgcatttctacgtttggttaatgcgtggtaccccgttgttactgcaattaatctttgtcttttacggcttaccgttgattgggattgtttttccacggtactacgccgcgttattcgcatttattctgaactacgcggcctacttcgcggaaatcttccgtggtgggttacagtcgattgacaatggtcaatatgaaagtgcacgggtcttgcggctgagctactggcagacgattcgtaaaatcgttattccccaagtgatcaaaattgttttaccgtcagttggcaatgaagtcatcaacttggtcaaggattcatcgttagtttatgtcattggtctcggcgacttgttacgtgccggtaacgttgcgacagcgcgcgatgttactttggtacccttagtattagtcggaatcatttacttagcactgacagccgtaacgacttttgtgcttggacgaatcgaaaaacactacagttactggaaatagggaggccatcatatgttagaactaaaaaatattacaaaaagctttggttcacggacaattattaagaatttgaatttaaccgttaaggatggcgagattctaagtattgtgggcccttcaggtgctggtaagacaacgttattacgctgtattacggggcttgaaaaggtgaatgccggtgagttcttagtcgacggccaaccatttgacccctatactaatcggagtaacgatagtgtgattggtgttgtattccaaaattttgaattgtttcccaatttaacagtcatgcagaatattactttagcaccgaccacggtcttaaagcagtctagcgcagaagcagaacagcaggcgcagactttattagatcgtttgaatctcggtgatcacgctgaccagtatcctttcgaattatcaggtggtcaaaagcaacgagtggcgattgcccgggcattagccatgaaaccgaatgtcttatgctatgatgaaccaacttcagcacttgacccgaacttacgacaggaagttgaaaagttgattttaggcttaaaggctgatggcatgactcaaattgtggtgacccatgatttaacctttgctgaaaatatcgcggatgaaatgttccacgttgaaccaaccaagaagcaataggggggcgtcagaatgaagaaaagattatttgcactcagtttgatcgttgtgatgctcctgggtatggcaacgacgttaagtggctgtggtcaaaatgtgactaaacgcgctgacacccaagatacttggtctaaaatcaagaaacgcggttacgttgtcgttggtttggacgacagttttgtcccgatgggctttcgcgaaaagtctgggaaactagttggttatgatatcgacctcgcccgggccgtctttaagttgtacggtattaagatcagctttcaaacgattgactggtccatgaatgcgaccgaattgcgcaatggcacaattgatttgatttggaacggttacacgaaaaatccccaacgtgaaaaagtggtggctttcagtaatacttatttgaagaacaagcaagtcctcgtttctttaaagaaaaatcatattaactcatttgacgatatgactggtaagtcgttgggtgttcagtcaggttcttcgggctatgagtcattggaaaacaatccgaaactgctgaaggataagattgctaagaaaacgccagttcaatacgataccttcacgaatgccttcctcgacttgaatgctggacgaattaaagggctcttgattgatagcgtctacgcgagctattatattaagcacgaagcgaactctgcggattaccaagaaacgcaaggcacctttaagtcggaagacttcgcagttgggatgcgtaagggtgacaaaacgatgaaacgcaaaattaatgccggcctaaagacgttgaaggctaacggaacgttagataagatcaacaagaaatggtttggtaatcaaaaagttgaaaactagcgtgacgtggcaggacttgtcattcagtgaccccagttatcggtgagcaactaatcataaataggctttccaagacggacgatgtcttggaaagcctatttatattggcacgcagacaaactgggattgaaggcttaaacttatacacgaaaaattgttgaaaggtgccgctataaggccaaaaacaaccagctaaggcccgctggaaaaagttcgagttttgcataaacttgcttggctagcgtcgtcctaagccgacttccaggcatttctgccaattgctggaacgcggtggacacagatttaagccgaagaccacgtcttaaatactggtcttccactaaccaagcaaagaacgcttgctaagtggaatttcaccgctgagcattggccgaaatgccttccagtcgggacagtattcgaatggcggacgaagatgtacctaacttgtgatggacttgtcattactttttataaacgataactttgtcaagcaacggtcagacagaaaatgatattgttatggttcactatttctgaaccaatgtagcaataattgaacttctcgataaacatagagatttacacctgacgctttatttgaagctccggtattaaaagaccaattacaccaagttaagtggccgttaatcagccattcgagcggcttaacgaaacgcgcgcggtgacgctgaatcctgtgcttgctacgccaacggactgatgcccaaaccgcattaatccgttgactaggcaatgcttaaattcaacccgtgatccctcgcacactttagactggaggggttgggtgacaatgctcagtagccaaattattcttagctgaaagtgggttgctttcggcttagaataagactcgtatttgagatgatgcgggttgggcattagctcaaatcgacgtcggctgcgttccagcaattgtcacccagccccggaggtcggaataggacacgtacatgctgacgaacgagtatccggggtcaattgccggcacctttcaacaacaattgatgaaaaacacggccataaaaaatgcccgactagttgactagtcggacgtatgggttaatcgaaaaattctttatataacgcaataacggcttgatcggcatcattgtcgtgtacaccgaacataatagaaatttcggaggcgccttgattgaccatgattaatttaatattgtcgttggctaatgcggtggcggcacgtgacatgatgccgacgcggttgcgcatgttttcgccaacgagcattaagattgagtagtcgtgcgtaaagtaaatttcatcgggattgatggccgctgagatttctgcaactaacgttttctctaattcgggcgtcaactgatgttcatcaaagatgatggtcaaatcatcgatcccagatggcatatgttcataactaatatgatgattttctaaaatcgttagaattttacggcccagcccaacttctttgttgagcagatacttacgtaagtatagtgaacaaaaactagaagaactggcaatcccagtcaccgggtagtggggattgggttcgcgagttgactgaatcaaagttcccggggcctcgggatggttcgtattcttgacgttgacggtaatgttgccttcgattgctggaatcaacgcttcgtcgtgaaagacagaaaagccagcgtaagaaagttcgcgcatctcagtaaacgtcatttcactaatggccgctggttttgcgaccaaactaggattgaccgcgtaaattgcatcgacatcggtaaagttttcataacgttcagcatggacgccccgagcgatgatcgcaccagtaatgtcggagccaccgcgtgaaaaggtacaaatttggccgttacgattgtaggcgaaaaatccggggataactaggatttgttcgctgttggcccacttagcgagctggtcataactactcttgataatctgagcgtcatcgggaacgtccgtaacgaccattcccgcatctttagggtcaaggtagcgagcgttgaggccgctttgttggaaaacagcggcgaccagttgcgcattgagacgttcgccgtgcgctttgaaagctgccatcaagtaggtgttgtcggcgtatgattgttttggtaagttgcgaatcgtttcaaaaatcggagtcaattgtgcttcgggaacgttaaacccgtgaccgatttctgcataacggtcaatgatagctgcggtaacggcttgcgtatcttgatgatggatcgtttgacgggcatattgaataagtaaatcagtgactttggtgtcgccatcgaaccgtttaccaggtgccgatacaatcacatatttacgtttttgatcagcctcaacgatcgcgaggactttttgcagttgctgactactagcaagggaactgccaccaaatttaattactttcacattaaccgctccttaattttatcaataatgaaaagaatagcagacaaatcgcgacttggcaatgttaattgccactcacgagaatttaatttaatcgtgaaaataatcattttggcgaccataatctgaaaataaaaaaaacaataggacggaaagttgcgtcaatccggcctttcgcttattatttattacatatgcaaggaggaaacatgttgcaaactcagttagcaaaaggggtccaattgacgacggttcagagtcatcaatttaaaaccaaccagattattatcaattttcgggcaccgcttgcacgtgaaacaattactcagcggtcgctactatcgaatttattagaaacaagttctcgtgattatccagatcagcgagcgttagccaacgcattggctgccatgtatggtgctgcgtttggtgcgggtgttagtcgtaagggaccaacgcataacttgcaattagccatcaccgttgcgaatgaacggtatttggcaacggatcagccactgacaaatcaggccatccagtttttacaacaagtcgttttacaaccgctagtggcggacggtcagtttgatcaagcgacgtttgaccgccaaaaaaagaatttggaagcggcgattatgtcggtcgctgatgataagcaatattatgccgcacagcagttaaatacggcgttgtttgcggacgaacctgcgcaacaagtgccaagttacggtacggtgagtgatttggcagccattactgcggaaggtttgtacgactattatcaaatgatgatccaaaatgatcaaattgatattatcgtgacgggtgacgttgatgaagcggccgttttagctcagtggcaacaagctggttttgaggatcgactggcggggcgcccacggccattttatcaacatcataatacaaaccagtacgtcgaagtgagtgaacaacaggcactcagccaagcaaagctaaatttaggttatgatttgccagtcttttatcgtggcaatcattattacgcggccttggttttcaacgaactatttggtgggtcaccgctgtctaaattgtttatgaatgtacgtgaaaaggcgagtctggcttactatgccagcagctcattggatactttccgtggggtgcttaaggtgcaagctgggattgatggcaaaaatcatgaccaagtgttagcaattattgcggcccaattaacggcgattcaagccggtgattttacggatgatttagttgaacagctgaagctgggcttgatcaacgattttgagtccagtttggatagtcaacggacattcgctgtgcaagccttgatcgatgatttaacgcaacaacgcgttacggatactgaatggctacggcagattcaaagtgtgacgcgtgaacagatcattgcagtcgcgaagatggtgacccttaataatgggttcttcttgagtggggtaaccgcatgaaagtaaaaaaatatgatcaatttaatgaaagttgttatcaagctcagttggataatgggctgacggtgacgttgttacctaaggccggttatcacaaaacgtacgcaacgtttacaacgaactatggctcgatcgacaatacctttgttccagccggaagtactgaaatgcaacgcttcccagatggaattgcccactttctggaacataaaatgtttgagaaggctgaccatgatgcgtttcaaatttttggtcagtacggggcgagcgcgaacgccttcactagcttcacgaagacgagctatttgttctcagctacccggcacctgcaggacaacctcatgaccctcttagattttgttcaagatccgtattttacgccagcgacagttgacaaggagaagggcattattgggcaagagattgagatgtacgatgatgatccaagttggcgcctgtatttcggaatgattggtaatctatatccgaaccacccactacaatatgatattgcggggacgactgagtcgattgctaagataacggctgatgacttgtacgccgcttatcggacgttctatcatcctgagaacatgacgttatttgtggttggtaattttgatccagacgaagtgttagggtggattacgactaatcaagcaactaaaaaatttgctgcctttcaaccgattgaacgtaagattcctgaaaccgcaacggatggacatgacattattccttatcggacgattgatatgccagtcaatcgggccaaatcaatcgttggtgtcaaaggcttgctgccgattgaagcgggggctgctgctttgaagtaccgtgcagcggttaacgttttattagaattattgtttggcgatacgtcagcagattatttgcgattatatgatcagggtatcatcgatgatacgtttggttatgatttcgaattacagtctggatttaattttgtcacttttagtggtgaaacggatgatccagcccagtttgatgcagccatcattgatgtgctagaaaactggcggacggctgtagttggtcaggaagcagcactcgcattagtcaagaaggaaatgattgggcgggtcgtcttcatggcgaactccttggaggcaatcgcgaaccggtatgatcaacggctattcgggacggcgacaatctttgatgaaccgggtataattgatcagttgacccttgcagacttgcagacggttgctgaacaattattgacttctcaggcaatcagtgaataccagattcgaccacaagcaaagagttaaggaaatctgaaatttaatggtcatggggctgctaaatttagttgctgtgatatactattaaccgtaagattttgaaaatagacttagggtggagaaaaagtcaatgagtgaaaataacgaagaaacaacaacgattggggcgcgcttaaaggctgcccggacagcgaaaggcctcacaattgatgatttgcaacaaatcaccaagattcagaaacgctatttgattgcaatcgaagatgaacagttcgataaacttcccggtgatttttacgttcgggcgtttgttaagcaatatgcggaaactgtcgatttagatggtaacgcgttgttagaagaatatcgagaccaattaccgagtgttcatactgaaaccatcgttgaaaatgttgatgaagttcaacctacccgggttgctagtcgcgaacaacctgcttcaccagcgagtcgcgtacgtaactatttaccaacgatcatcgtcactgccattgtggttttgattttgttatttatttggtttatggcggttcgcacgcacgctggttcaagctctagcacgagtgcggacagttcttctgtacaagtttcgagttctaagaagcaatcgagttcgtcgaaagctagttcatcagcaaagtctagttctaaagcgtcttctgccaaggaacaaacaatcaaggctaacggcagtagcgatacggcttatactttgacgaatggtgcggataagaacaaagtggtcatcaagtctactaaggctgcttggacttccgttacgactaacggtactcagacttggcaaggaacgctaaaggcggatggctcacatacattaacgttaccaagtaatgctacgacggttaagttccagtttggaaacgcaactgccacgaccgtaacaatcaatggtaaggcgttcaattttaatccgaagaacagtacgtcacaagttcggacgattaccttgaccatcaaataacgttgcggaggaggcgggtactttgaatttacctaataaattaacggtgtttcggattattctgattccagttttcattcttattatggtgttaccccttagttggggacaggttgtgtgggctggaacaacaattccagtcacccaagtggttgcaactgtcatttttgcggttgcgtcattaactgacttagcggacggcaagattgcccggggtcaacacttggttacgaattttgggaagtttgcggatccactggcagataagatgttagtaatgaccgcgttcatcatcttagttcggttaaatgcggcccctgattgggtcgttgccattatcatgtgtcgtgaactcgcggtaacggggttacgattattgattgttgaaaataatggtaaagtgatggctgctgctatgcccgggaagattaagacaacgacacaaatgattgccatcatcttcctgctgctgaacaatgtcttatttgcggcaatccacattccatttgcggcaattatgttatatatctgcttattcttcgttatttattctggcattgattattttgttcagaatcgtgacgtgtttgcagatggcttcaaataaaattaatcatgagcgtctcaccgagtcttgcattcagtgagacgtttttgtataccattgtgttgccctattaattaatcatgactcctgtcagtcgataattttaacgatgagtcgcgttggcaggttatgtcaaatgaaggtatttgaaaatgctaatctttttaatggggtcgatcgtcattttcgtatatacttaatgtaggacgataatcatcgcgcccacactgagtgtaatcgataggattacggggaggcatatatggcatgcaagcagaaataatcgcggttggtaccgagattttactgggtcagattacgaacacgaacagtacgtacatcgcacgtggattggccgaattaggaattgatagctattatcaaacggtggttggtgataatcggcaacgtttgtcgaccgtcattgaaattgcggcccagcggaatgacttagttattttaacaggtggtttggggccgaccaaggatgacttgacgaagcagacgctcgcgcattatttgaatgttgccttggttgaagatcaggcagcaatgcaaaaaattacggcctggtttgccactaatgacaaagtaatgacggccaacaaccgattacaggcattgtatccggcaggcgcgcaaccgttgactaatcataacggaatggctgttggtgcgttttatcagtcagaaaatagtgctgatttcttgttattgccaggtccaccccgtgagttagccgtaatgtttgattctgaggcaaaaccgaaattggcagctgcatatggggaacaagcccaaatctattcgcgagtgatgcgtttttatggcatcagtgagtctgaattggcgacccggttgcaacccttgattgatgaacagcaggcggttacgatcgcaccctatgccaagactaacgaggttaccctcagattgagtgcccaagctatgacggaaacggctgcaaggggaatgatcgacaaagttgaccaccagatcaaggctaccgttgggccgtacttttacggttatggagacgataactcgttagttactactgttattaatcaaatgattgcggctaagctgagtattacagccgcggaaagcttaacagctgggctgtttcagagtaccatcggcagtgtgtccggggtttccgcaatctttccgggcggctttgtaacgtatgcgaatgaggccaaacatcagctagtgaacgttccacaagcaattattgacgctgagggcgtggtttcagaagcgaccgctaaggccatggcgagtggtgctaagcagcagctaaatactgatgttggtatcagttttacaggcgttgccggtccaggaaccttggaaggtcaaccggctggaacggtatggattggtcttgcttaccgtgatcgacccgtgaaggccaagcagtaccattttgctggtaatcgacaacaaattcgggaacgcagtgtgatggccgggttagacctattgagacatgcattgaatgaagatacggacttaaaaaaataatacgaacttttgttcgctttttgcttgcaattctaactttgaacagctatgatattaagagttagaaacgagcaccaaaggaggaaataatttggctgatgcacggaaagcagcactagatactgccctgaaaaagatcgaaaagaatttcggtaaaggggcgattatgcggatgggtgacgctgcccagacgactatttcaacgatttcaagtggatcgttggccttagatgacgcgttgggtgtcggcggctacccacgtggtcggatcgtggaaatctacggtcctgaaagttcaggtaaaacgaccgtggcactacatgcggttgctgaagttcaaaagcagggtggtacggcggcctatatcgatgctgaaaacgcactagaccccgtttatgcggaacacctaggggtcaacattgatgacctgttactttcgcaaccagatactggtgaacaagggcttgaaattgcagatgccttagtttccagtggtgcggtcgatattttagttgttgactcggtggcggccttagtgccacgtgccgaaattgaaggtgaaatgggtgacgcacacgttgggttacaagcgcggctgatgtcacaagcgctccggaagttatcagggacattgaacaaaaccaagacaatcgcgttatttatcaatcaaattcgtgaaaaagttggtgtgatgtttggtaatcctgaaacgactcctggtggtcgggccttgaaattttacgccacgattcgtttggaagtacggcgggcagaacagatcaaggaaggaaccaatattattggtaaccgtgtccggatcaaagtcgttaagaacaaggttgcaccgccatttaagcgtgccgaagtggatatcatgtatggtcaaggtatctcacaaactggtgaaattgttgatatggctgctgaaaaggatattgttaagaagagtggttcttggtattcatatggtgacgatcgcattggtcaaggccgtgaaaatgccaagaagtatttggacgagcatcctgatgtcatgacggagattcgccaaaaggttcgtgatgcatacggtatggatgcaactggtgaagaaacgtctgaaactgatgatcaggccaaagaagctaaggataagggaactgctaagaatggcagtaagggtcaaagtaagtccactaaagcgacaccagcggaaactgctctcgatctcggcgaccaaccaaccgaaaaatagacagtttgttatgcaacgcccaaaatatttattttgggcgttttttgtacatacttagcttgtttgcacgacaaaagtagcctgcagagagcggttgccataagactttaagttgacactattcgtttctaacattagaataacaagtgtgtaaataatcaaaatataacatctgaaaatttgtagttgattttatgttaactggattttggtggtgcggaggtggaaacatgaatgttttcggtataatcctcgcagtcatcgcaattgttgtcggttatgggattggttactatgtacgcaagaacgtccatgaaaaagaattggacgttgccaggaacacagccgaaggtattatttctgaggccaaacgggcagcggagactcataagaaagaaaaagtccttgaagctaaggaagagagtcatcgctaccgggctgaagttgaaacggagttaaagcaacgtcggaatgaagttcaaaagcaagaagaccggttgcttcaacgtgaagaaactttagatcacaaagagaatacttttgaaaagcgcgaggatgctttaggtaaaaaagaagataagattgccaatgagcaaaaacgcgttgaacaacagcaacaaagtgcagcttcactaatcacgcaacgtcaagctgagttagaacgggtcgccgccttgtcgcaagaacaagctcgcgatcagattttgacccaaacgcgcgaacaattaacgcatgaacgggccgtgttaattaaagaaaatacggacgaagtgaaagcgcagtctgaaaaagaagccaaaaacttaattgtccaagcgattcagcaaagtgctgccgatatggtttctgaaaccacggtttcggtcgtttctttgccgaatgacgacatgaaaggccggattattggtcgggaaggtcgtaacatccgaacgttggaaacgctgacgggaattgatttaattattgatgacacgccagaagccgtcgttttaagtggttacgatccgattcgtcgtgaaatcgcaaagatcgcgcttgaaaagctgattcaagatgggcggattcatccagctcgaattgaagaaatggttgaaaaagcgcgtaaggaaatggacgaaaagatccgtgaaactggtgaacaagctgtctttgatttaggattgcacgggatgcatcctgacttgatcaagcttgttggtcggctgaattatcggaccagttatggtcaaaatgttttgaatcactcaattgaagttgcgaagttagcgggcgttttagccgctgaacttggtgaagatgttacactcgcgaaacgcgcaggattattacacgatattggtaaggccgtcgatcatgaggtcgaaggttcccacgttgaaattggcgtggaattaacaacgaagtacaaagagagccccgtcgtgattaacacgattgcctcccatcatggtgatgtggaagctaagtcgattatcgcggtgttggttgcgacgtctgattcaatttcagccgcccggccaggtgctcggagtgagtcgctggagaattatattcatcggctcgagaagctggaagcgatcgctaataatgaggatggcgtcaagaagagctatgcgattcaagctggtcgtgaaattcgagtcatcgttaagccaaacgagatttctgatttacaggcaacggttttggcgcacgatgtcaaaaagcagattgaaaatgaacttgaatatcccggtcatattaaggttacggttattcgggaagttcgagcagtggattacgctaaataaccgggaaatgagtttaggtcttgacctaagctcatttttttagttgccagcagaattcaatcacgttttcaaggctaaataatgctaaaataattggtataacgttaaaacaagggagcaatctatgcgaattctatttgttggggatgtcatgggcaatgtcggccaaacggcggtcaccacgtacttacctaagttaaaacggcgctacaagccacaagttactattgttaatggggaaaatgccacccgcggccgcggcattaatcaggaagtgtataaggacatcttgactgcgggggctgatgtcattacgatgggcaaccacacctgggataataatgaaatctttgattttattaatggtgctaagaagttgattcgaccgttgaactttccgccagcgacgactccgggggttggttatacgatcgtgaaggtcaatacggtgaagttggccgtgattaatcttcaaggaaacgtctttatggggcaaaatttagcggatccttttacgactgtccaaccattggtcgagcaactgcgggaagagacacctaacatcttcatcgactttcacgctgaaacgacaagtgaaaaagaagccatggcgtggtatttggatggtcaggtgagtgcggtagttggcacccatacccatgtgcagacgagtgatgaacgcgtattgcctaatgggacggcctttttaagtgacgttggttttacgggtccgtataatggtattttagggatgacccgtgagaatgttattcagcgtttcttggaacaaatgccgacccgtttcaacgtgcaagaggatagtccggcagtgttgtcgggttgtgtgatcgacgttgatggtcagagtggtcgggcgaaaaagattgcccggattttgattaatccggatcacccatattttgatgactaagatttacgatagaaagtaggattaagcgtgccacagaaaacaaaagatacaccgatgatgcgtcaatattttgcagttaaaaatcaatatcccgatgcgtttttattttaccgacttggtgatttttatgaaatgttttttgatgacgcgattaaaggtgctcagttattagagttgaccttaacgacgcggaatcattcggcggaaaaccccataccgatgtgtggggttccccatcgagccgtgcaaaattatattgatattttagtagataaaggttacaaagtcgctatttgtgaacagatggaagatcccaaattagccaagggcatggtcaaacgcgaagtgattcagctcgtgacacctggtacgacgttggaacggggcgcggaacaagctaagacgaacaattacttgactgcgctgattcagcgtgatcaacaatatggttttgcgtacgccgacttgtcgactggggaactaaaaacgagtgtcttaacgactaacgataccctaattaacgagttgaccagcttgcaaactaaagaaattgtggtcgacgactctgttgctagcgatttgcgcgatcaaattaagacgctaggaattctaatttcagaacagaataacgtcaccccccaggctgaattgagctacttgactcaggacttgacggtcgatttggaacaacaggtcgtggaacggttattgatgtatattacggtgactcaaaagcggagcctcgcgcacttacaaaaggcgatcgcttatgagccgtcatacttcctgaaactcgatcataattccaagtataatctggaattaatgaagtccatccgaactggtaaaaagcagggaactctcctgtggctattagatgaaactaagacggcgatgggcggacgactattaaagcagtggatcgaccggccattgattgtgaaggccgatattgaaacgcgtcaaaataaggttgcgacgttattagatcattattttgaacgtagtaacttacaagaagagttgactaaagtttatgacttggagcgtttagctggccgggtggcttttggtagcgtgaatgggcgtgacttagtgcaactcaagacatccttgcgtcagattccaaagattcggtatatcttatcggaattagatacgcaggtatttaatgatgaagttaatcagctggatccagtcgaagacgttgcggatttgattgacgcggcaatcgttgaagacgcgcctttgtcagtaacggacggtggtgtgatcaaggatggttataacgagcaactcgatcaatatcgggatgctatgaataatgggaaaaaatggattgctgagttggaagcccaggaacgggcgacaaccggtatcaagaatcttaagatagggtttaaccgggtcttcggctattatattgaagtcacgaaggccaacttggcccaattaccgaaggaccgctatgaacgtaagcaaacgttaacgaatgctgaacgctttagtactcctgaactgaaatcgcatgaaagcctaattttagaagctgagagccattctacggatcttgagtatcaactcttcacaaaggttcgtgaaacggttaaaaaggcaattcagcggctacaaacattggcgaaggcggtcgcagcaattgatgtcttgcaaagtttcgccgtcgttagtgaagattaccactttgttcgaccgaaattaactaaatcacatgatttgaagatcgttgatggtcgtcatccggtcgttgaaaaagtgatgggcaaccagagttacgtcccaaataacgtgacaatgtcacctgatgagacggtccttttgattactggtcctaacatgtccggtaaaagtacgtacatgcgtcaattagcattgacggtcatcatggcgcaaattggttgttttgtaccggctaaatcagcgcaacttccaatttttgaccaaatttttacacgtatcggtgccacggatgacttaatttccggtcaaagtacgtttatggtggagatgcaggaagccaataatgccttgcaacatgcgacagccaatagtctagtgttgtttgacgagattggccgggggacggcgacttacgatggcatggcgcttgcccaagcaattattgagtttgtgcataaccatattcatgccaagacactgttctcgacgcattatcatgagttgaccgcgttagatcaagaattatccgggttacgaaacgtgcatgtgggtgcgactgaacaggatggcgagctcgtcttcttgcataaagttgagcccggggccgccgataagtcctacggggtgcacgttgccaagttggctgggatgccaacgagtttattggaacgggccaataagattttaacgagtttggaaaatcaaacgagtacggtatcgacgacagcggcttcgattgctgctagtgatgctgctaatagcgtggcacctaacacagcggcttcaatgccggttgaggccgccgatgagtcacagccagtagaatcggagaccccggttgccgaagctccggtcgctgaagccggtgatgaacagctgtcgttatttgctgagccggcggtgacggatgcgaagggtgaaaaggttttacaacagctgaagacgttgaacttgatggcgatgactccgatggatgtaatgaaccagctgtataaatggcaacaaaaattaggcaagtaggcgcattttaactcatcataaatgagcgcaataagctgttattatgatgagctattggtgcgtctgacggacaggtaggtcgacactagtcagttattgctagttgtggtaatcgaaaatgttcgtgcaggacacgagcttaattattttatgtgaaaggaccgatggaaatgggaaaaattcatgagttatcttctgtgctggccgaccagattgctgccggcgaagttgtggagcggcccgcctcggtcgttaaagaactggttgaaaatgctgttgatgcgcacgcgacgcaggttgatattttggtgcaagagtcgggtgttcagtcaattcgggttatcgatgacggtgacggtattgatgacgctgaagtcctgaccgcttttaaacggcatgcgacgagtaagatcacatcacgtgaagatttgtttcgcgtccattctttaggttttcgcggtgaggcgttgccaagtattgcgtcagtagcggacgtggtgatgaatacgagtaccggcgccactgggacgagtattcattatcgcggcggtaagctattacaacaatcgcccgctccgttgcggcaagggacggacattaccgtcaccgatttgttttttaatacacctgcgcgactaaaatatttgaagtccccccaaacggaattagcgaatattttagacgtggttaaccgcatcgcacttagctatccagcggtggcatttcggttagttcataatgcgaaagagctactaaaaacggctggtcgcggtgacttacaacaagtcattgctggtatttacggtgtccaaaatgcgcgcaagatggttgccattcaaggatcgaccactgattttaaattgagtggctttgtggctttacctgagctgacgcgggccagtcgccagtatattactgttctgattaatggtcgtgctatcaagaaccagcaattgaccaaagccgtcatcaaaggttacggttctaagttgatggtcggccgttatccaatcgcggtgatcgctttaacaatggatcctttattggtggacgtcaatgttcatcccacgaaacaagaagtccgtttgagtaaggaaccagaattagccaaactggtcagcaccacgattacggaccggttagtggatgtgaacttgattccgtcagcattgaccaatcttggcagccatcggcgtgaacatctaaatacagaccagctggcgatggatttgaacgccgtttcgtcacagtatcaagtagcggataagacaacgccggcatcgactgagcagtttgcagcctcgctggcagcggcaaccatgcagcccagctcggcaacgaccatggtaagtactacttcagcacagccatcagcggtaaaccgtgcagcagttagtgcggttgttccgtcagaatcagcggcaagttctgccaacccgccgattatgattagccatcgcgacgaactgacagctactccagttcaagcatttgaccagcgttaccagtcagaatcaggcgctttaccctttggtgaaactgctgaaccgttagaaaccagcacggctgcaagcgcgccgactagtgaagcgccggatacggaacgttttccacagttacgctatcttggtcagatgcacgggacttatctgttagctgaggcggatgatggtatgtacattttggatcagcatgcggcccaggagcgaatcaactatgaatattatcgccaagcgataggtgaggttagtgcggatcaacaaaatttattggttccgattattttagattacccgacgagcgatgttttaaagatcaaggaaaaattgccgttactagcagaattagggattcatctggaatcattcggcggcaacagcttcattgttcatgcccatccgacctggttcaaagctgggcaagaagaagatacgattcgtgaaatgattgattggctcttacaggatgataagttgacggtcgcccaatttcgggaaaagtcagctatcatgatgtcctgtaaacgggcaatcaaggccaatcaccatttggatgatcagcaggcccgcgcgttattagccaagttaccgacctgcgagaatccgttcaattgcccacatggccgtccggtgacggtacacttcacgaattcagacatggaacggatgttcaaacgaattcaggatagtcatgaagcacgtgattaaagtgattattggcggcgtactcgttactttagtatgattcgtaatcgatccgcattgtgcaagtaaatatttcatgaattatgattaaaacgtgccaagtttagattgttgttcgtcagccggtgtgcgtcctatgccgacctccggggctgggtgacaattgctggaacgcagccgacgtcgatttgagctaacgcataacccgcgtcatctcaaatacgagtcttattctaagccggaagcagaccacttccagctaagaataatttggctactgagcattgtccacccagcccctccggtcgggaaactgctcgaatggctgatgaacgaccacctaatttggtacaattagtcgctgactattttgatgctggaagtttaaacaaagcgctaggtgcattaagcactctgtaaagagattaaatcctactataccgattcaggattagtgagccatctcaatattatttttagtctgacagttgattgacaaaattaccgtttatgaaaagcaacgaccaattcatcaaaagttgggtacctcaccgtctgccattcgaatactgtcccgactggaaggcgtttcggccaatgctcagtggtgaaatttcacttagcaagcgtcttgtgcttggttagtgaaaggccagtatttgagacgtgatttttcggctcaaatctgtgcccaccacgttccggcaattggcagaaatgccttccagtcggtgtaaggcgcacacaccaagcaagtctacgctagtccgaactttttccagcggtcttaagctggttgcttttgaacttaagaaatggcacgttttaatcatgactgatactgaataatcacgaaccgaatgtgttatcgaataaaaatagcaatgttgagtagtccctgggttaaaaaacctagggacacttttattgtcgccagtattgcggtctaaaaaacaactttaagattggggaagtggcgtttgtgacactaatttgagttgtaaaatttcagattgaattggtttaaatagttagctatcattgattaaaatgagtggtgagcgcgtatcgggtgcttggaccactcaacatgattgggagttgattgttttggatatgaccaaactttattatcgccaggtttattcggcatattgttttttggcagatttaccagaggccacgcccgcgttcgtggccgggcgcaagacgctgtgggaattaaatgcgcatccaagtgcgcgggacgccaaattgattacgctgaatttatatgagcaagttgctgcttttgagctcgatcctaaccgtcatgatcaagcggcaatcgctacgatcaacttacaacgtgataatgctgtgagtggcttacaacctttagtacagttgtttgggagttatccggcgactactaagattgaaactttagataactgggattggcgttagttgttgatgggacagctgtgaatcacgaatttattaagattcaaactgaacatcacgagacgaaattgttcatggtaaaatagaaacattgtttgagatggcaaaatatggggattgcgttgtcgacgtaattacaagataggggcacctgatttgaagacagtacggaagataccactagtcgtctggtatacggcgatgtttgtggttattgcgacgattacttacagtgggcttttcttagccggccggacattgatttgggaagtggatggcatcgcccaacacttcccgattttattggaatttcagcggatcttacagcaccacccacaacaattattcagttggtcatggaatctcggcttgggggccgatcaactgacgactttttcctactacgtggtcggtgatccgtttaattatttagtggcgtttgtttcgcgcgctcatttggaatgggcctaccaagcgttgatcttgctgcgattgtacttcgttggacttgcttttctaggtttcagtcggcagttcaagttcaaacgtatcagtcaattgattggagctttgacgtatacgtttaccgcgtatacgttctatgttgggatgcaccacccgtttttcttgttaccaatgatttggtttccgctactgtgttgggcgattgaacgggtcttacgaggccgacattggttaccactcagtctgattaccgccgttgtaattttgagtaacttctattttgcttacttactcgcattgggcggtttagtctatgctttggtgcgtttctggtcacgtcgtcgtgaccatttaacgatgcggtcgtttggacagttattttggcggttactagtggcagttggtcttggtgtcacgatggcaggcatcttactagtgcccacgctgctcgcgatgttgacggcaacgcgtgcgagttttaactttgcgaatggcttgacgagttatcccatcaattattacgttaatttacccaatcgactgttgaccaatggtggcagtgtccaatactgggtgaccctcgggctgagtagcattagctttattgcaattatttatacactacgtcatttcagacgctattgggtgcttaattgggtactggtcgtgatgatgttgggtattttgttgcctcaatttgcggccgtattcaacgttttttcaacaccttctaatcgatggttgttgatggcaaccctcgtgtttgcttatgcgacgatggcatttatggaccaagtcactgctctgacagcggctgatttaaaatggttggctggtattagtggcggtctgcttgtcattatttggctgatcaatggattctatctcaatatccgcaaacatgatattgcgacatatctcatcttgttagcgttaattggggtcctgctggccaaacaatccttaaaattgaccaatcggcaattttatgtgttattactgggaattgtcacgctgaacctggcgaataacggactgggctggttgagtatcaatactaattctaatagtactgagcagttgcggcagggcgcggcaatgaaatgggtcaaaaattattttgatggcgcgcaaaaaagtttaaccacgactagccaattttatcgaacggctttggcacccaactactatacgatgcgttcggctgagagtgatgtgccgatggtgttaggaactcacacggttggatcgtatttttcagttcaaaatggttacgtgggggcatttagtcaggccttaggcaactcagagtatgcgatgaactcgccactcggttcgttggacggtcggacgacgatgtataacttattaggtgttaaatatttatttgcacgtgaggaccagttgaagaaacaagccttaccagccggatatgaggttgttaagatgaaaactggcgaaccgaagatttttgcggacaagtttatttatggcatgagtaatcataccggcacgatcttgttaaaatccaagaatgcgttgccgttagtttatacacagcagcatcagattagtcaacgccaatttaatcgcttgaacgcagttgaccgcgagcaagccttgttacaaggtgcggtcactacgcagcaggttagtggtgttaagactgtcaagccaaccgttaccggaaaaaacgtcgcttatacggttcaagcggatacgacgaatgttttggatacgttggacaaggtgattatttaccgcaatcaacatgcaacgggagcgtcgaacaacgcgttgactaagttaccggcagatacgatcacattaacgccggaacaacgagaaagtttgacgccggcaactggcctgacgacaccgtcaaaccgcgtgttgaacttgattgcagctaatcaaaagttagtccagaaaaatcaggaaaacaatgccgacgagttaacgagcatggtcagtgatgtgcaggggcaccagataccgtaccgattgaccattcaacaccctaagaagtatcgaaatacggaactctatcttgtgctagatggcatcagttatcggcgttcctcaatcaagcacgccttgacaacgagtcaaaataccaacgtgttcacggcccgtccgtataccaaagtcgattatctagatgatgttcgcgatggtctgaagggcaatttgagcgctagtgggtattctttaactgctcagacaacggataacttgacgagctttagtcagttgggtaccacgaatatgtcagattatgagccccggacatcagcagtaatcaacttagggtatagcaagtacgcgcgtaagctgattacgttgaactttacgagcattcgtagtttgcattttaagtccgctaaactgatcgctgtaccgcttgggaagacttatcgtcaacggacgcggcaactacagaccagtgggttgaagcatcaacaagtgacgaacaaccagattacgggaaccacgctgactaagacagcaaccgtgttaacaacgtcaattccgtattcgactggttggcagctacgagttaacggtcaaaccgttaggacccaagtcgtcaacaaagggtttgtgggggccaagttgacagccggccggcaccagattcggttgacgtatcacacaccaggactaaaaatcggcatatggtcgagtattattggtggtgtgattagcatactgattgcctgctggtgggggcttcacaaacgtgtcagacaatcttaattgagtaaatcggtattaaaataggcttcttaggaattaactttgattcctaagaagcctatttaacgttagatggaacacaaacgaatgtatgccatagcgaaattcacaattaacagccacgactggttaattatgaggtgtcgctaacgcaattaattgttcgggaatgaccggtgcagtgactaatttttgccattcactggttgagactaacatgacgagtggcgtgctgaccgttgtcaaccacgttttctgcgggataacgggtgccatggccgttgtgatgtcggtattgacctcagactcagtaatctgccagagtcgatgtgtgacgtgcgcggtatccgtcacctcgacgaccggggcaaaatgaccgacccagtcgtcaatcaacatctcgataacgggctgctgtgggtaaaggactgtgttgatcgtgccgggaaccatggtcgtcacggtttgatccaccggccagctgccaattaagcgccactggtgaacaccgttgagtgtgagttcgtaccagtaatagctggcttcggttgtcgtcattgtatcctggctgtcccaattggtcgcagctgtttgaattttagtttgaccagttgtggtcggtaacaccgctttaaacggtttgagttgcatagcgagacctccctaggactttgagcatagcatgacgttaacgtggcggcaagcatttcttgcaacgaaatccgtcaatcgaggtgaaattgatttaacattaaaatttgttttttatcggtgcaccagtgttaagccactgtgaaaatgtggtacaatttagcaagcaaacatacgttttatttaaaggagttttttcggtgtacgaatattttctcggtcaagtgaccgatgtaacccccggttatgtggtgattgaggttagcggcattggttataaagtgctaacggctaatccataccgttaccaggtgggcccaacagcagttaagatgtatatccatcaagccgtcagcgaaaatggcatgagcctatttggcttttttgatgctgacgagaaggcgttgttcgaaaagttgctcggggtttcgggaattggtccgaagtcggccctcgcgattttggccaacaacgaccatgcaggtctgatccaagccatcaatcaagagaatgcgacttatctgacgagttttcctggcgtgggcaagaagacagctcagcaaatcgtgctggacttgaaaggtaaattaaacgatctaaacgttgatgtgactggtcaaactgcgctcgatgtggatgctcctgctgttgatggcgcgttagcggacgcgttggcggctctggaagctcttggctattcgaaagcggatgtcaagaaggtcactaagaagttggagacgtttagtcagacacaaggggccgatacgaacaccttgttgagtgaaggactacgactattgatgaagaagtagatgggaggggtaactaaatggacgatgacaagttattatccggtgacaaagccgatgacgaagaggcgtcattagaaaaatcgctccgtccgcaaacgttagcccagtatattggtcaggcccgggtcaagcacgaattaggagtgtatattgaagcggcccgcaagcgtgaggaatccttggatcacgttttgctgtatggtccaccgggattagggaagaccacgctagcgatggtaatcgccaacgagatgcaggtcaatatccgcacgaccagtggccctgcaatcgaaaagccaggtgatttggttgcgctcttgaatgaactggagccgggtgatatcttatttattgacgaaattcaccggttaccgaaaatcgttgaagaaatgttgtattcggccatggaagacttttttgtcgatatcgtggtcggacaggggccaaccgcccatcccgtgcactttccactgccgccgtttacgctgattggcgcgaccacccgagctggtatgctgtcagctccgttacgtgaccgatttggaatcgtcgaacatatggcgtactatgaagttgctgatttggaagatatcgttaagcggactgcagatatttttcaaacgagtatcaaaccatcgggtgcccacgaaattgcgcgtcgctcacggggaacgccccgcattgctaatcgcttgttcaagcgaattcgtgattttgcagaagtggcggatcaagacgccattgatgaggccatcgtggcgcgatcactgacatatttacgcgtagatgatgccggcttggacgagactgacaataagctcttacgaacgatgctagagtattatgacgggggtccggtcgggcttgctacgattgcggccaatattggtgaagaaacggatacaatcgcggaagtggtcgaaccgtacttactccagattgggttcttgaagcgaacacaacgtggacgcgttgttacaattaaaggttatcagcatttgggattcccatacccagaaaataaataaagataagaggtcacaacatgagtttaacacttgaagattttgattatgatttaccacatgaactgattgcccagacaccaatcaaaaaacgggatagttcacggttgttggaattggatcgccaaacgggcgaaatgcaagataagcatttctacgatattattgatcaactcaatccaggcgatgcggtcgttatgaataattcccgcgttatgccagctcgtttgtatggtgttaaacctgaaactggtggtcacgctgaagtcctattattgcataatacggaaggtgatgaatgggagacactcatgaaacctgccaaacgtgccaaggtcggtaccgtgatctcatttggcgatggtaagttgacggcgaccgtaacggccgaaaaggaagatggcattcggatgatcgagtttcattacgatgggatcttcatggaaattttggagagcctgggtgaaacgccattgccaccatatattaaagaaaaactcgatgatccagaccgttatcagactgtttatgccaaggaaaatggctcggcagctgcgccaacagctggtttacactggacgaaggaactcttacaaaaagttcaagacaagggtattaagttggtttacttgacgctgcatgtcggactagggacgttccggccagttgaagaagataatatcgatgatcataagatgcacagtgaattttatcgattggacgaagatgctgctaagacgttgaatgaagtacggcaaaatggtgggcgcatcattgcaaccgggacaacgtcaatccggacgttagagaccattggtagtaagtttgatggtgaaatcaagccggattcgggttggacggatatctttatcaaacctggttatcaatggaaagtcgttgatgcgttcatcacgaactttcatttaccgaagtcgaccttggtcatgttagtggctgcctttacgggccgtgatatgattttgaaggcttatcaacatgcgattgatgaaaagtatcgcttcttcagttttggcgatgcgatgtttattcactagtataactggctttaaacgagatcgcttattttgaaacggatgacggttgaatattaaaatgccgtattatacgaggcgtatcgctaatttcaagctgccgttttagctctggagataataaagattgtcaatagtcgcttcaagaagttaaaatgcattcttgaggcgactatttgacgtttgaacgctttgttaacagactgactaaagccacgtgggtgcccacgccaattgccgcgactggttcacggctggatttcgtgctatcattatttgagtttagcaacattttaatacggaggaacagatatggaaccggcaattaaataccgattaattaagaaagaaaaacacacaggagcccgccttggcgaattgattacgccacacgggacctttccaacaccgatgtttatgcccgttgggacgcaagccagtgttaagtcactggcacccgaagaattagacgcgatgggtgcgggtgttatcttatcgaatacgtaccatctgtggttacggccaggcgagcaaatcgtgaaagaagctggcgggttacatcagtttatgaattgggaaaagggaatcttgacggattcaggtgggtttcaagtcttttccctggctaaaaaccgtgatattacggaagaaggggtccactttaagaatcatctgaatggctcaaagatgttcttatctcctgaaaaggccattcaaatcgaaaatgatcttggcccagatatcatgatgagtttggatgaatgcccaccattctttgaaagttacgactatgttagcaagtcagttgcccggacaagtcgctgggcagagcgggggttgaaggttcatcaacatcctgattaccaaggcttatttgggattgttcaaggtgcgggctttaaagacttgcgtgaacagagtgccaaagatcttgttagcttggactttccaggctactcgattgggggcttatcagtgggtgaatcgaaggctgagatgaatcatgttttagacttcacgacgccactattgccagaaaataaaccccgttacttgatgggagttggctctgcggatgccttgatcgacggtgcaattcgtggggtcgatatgtttgactgtgtcttaccgactcggattgcccgtaatggcacttgcatgacgtcccatgggcgtttagttgtcaaaaatgcggcctacgctcacgatttcaccccgttagatgataattgtgattgttatacctgtcgtaatttcacgcgtgcttatattcgtcatttgattaaggcggacgagacgtttggtttgcgtttgacgagttatcataacttatatttcttgttacacttaatgaagcaagttcgtcaagccattatggatgataatttactggagtttcgccagaacttctttgaaatgtacggttttaacgataaaaacccgaaaaacttttagtgctactggtatttcagaccgtaatttgttaaagttaaagatagtcaaacttttaattagagtaggagcgatattaaatgggtcaaatggcatcaattctgtttatcgtggtcatgttcgcattcttatacttcttcatgatccgtccacaacggaaacaacaacaacaacatcaacaaatgttaagcaaaatcaaacgtggtgacaaggttacgacaattggtcgcttgcacggggtcgttgatgaagttaacgaaaccgaaaaaacagttactttagactgtgatggcatctacttggtttttgatttgaacgctgttgctaagatttctccagccgaagatgcacaagctaagacagttgcaccagaatctggggcagcggctgaatcagctgctacttctgaagttgaatcggcaagctcagccgccgacgataatgctgattctgaagcaaaataggtttacaccataagtggtcgatcattactgatgaccgcttatttttttgcttattttttggtcttgaaacgcgcttttgaacgtatgttcgtgtataatgaaagtactaaggattggaggggcggcggatggcacagtcaattgttgaagcgcctattcgggtggatacgagtcggaaaattattcatgtggacatggacgcgttttatgcgtcgatcgaagagcgggagcatccagcctacaagacgcagccgttagtgatcgcgcatgatcctcggcagacaggtgggcgaggcgttgtgacgacggctaactatgttgcccgccaatttggtgttcactcggcgatgccagctgctaaagcattagaactctgcccaacagcagtatttaagacgcccaactttccgttgtaccgcgaagtttcggcgcagattcatcgtattttccatgagtatacagagatgattgagccaattgcctttgatgaggcttacttggatgtgactacgaataagaaacacatccatagtgcggtcgaactggcgcaccgattacaacaagaaatttggcatcaaacacatttaacttgttcaacgggaatctcctacaacaaattcattgccaaactagcatcagattatcgaaaaccagcgggtgtgacgatcgtattaccacaggatgcagaaccatttttgttacgtgaacccatcgagaaatttcggggtgtcggtaaaaagacggtacctaaaatgcacgatttaggaatcaagactggacaggatttatacgcacagtctgaattagacctaatcaaacaatttggcaagttgggctatattttataccggcgagtgcgcggcagtgatgatcggccagtcgagtatttacgtgaacggaaatcaatcggcaaagagcggacgtttggaccgtttctccaatcgacgacggaagttaatacgcacttgaaggccatcgctaagttggtagcagctagcatgcaatcgcatcagcgccacggtaaaacactcgttctcaagttgcgttacggtgactttgtcacaattaccaagcggcgaacgttcggtgaattcatacctaatgacgcggccttgtttgagcagtacgccgaagagatttttgaagaggtggtcgatgatcattttaactctggcatccgcctgttagggatcacgctaactggcttggcaccactggcgtttgagaacttaacgttaccactttatccaaatgataattaatttatttggcgcgacgcggattcttcggtatactggagtactgtgacagtttaatcgccaccagtaaattatgagagtaagaaggttcatttatgaccgtccaaacagcaatttttgacttaattaaacaagcaaaaacaatcatcattcatcgtcatcagcgacctgacccagacgccatcggaagccagttagggttagcagctatcattaaagctagctttcctgcgaagcgggtattgacacctggaaaacagtaccatggttttgactggttaggacaaatggatgaggttaccgaagcggactatcaagacgcactagtattaattcttgataccgctaatcagccccgaattgatggtgaactttggaatcaaggtaagacaattgttaaaatcgatcatcacccaaacgatgacgctttcggtgacccacagtgggtcgacgttgatgcttccagtacgagtgagatgatttataattggtacgcaccccttgcggcggagttaacgctaacggctaacgccgctcggttgttgtatgccggcatcgttggggacaccggtcgctttctatactctgcgaccaagcctagtaccatgcgagcagcagcggccttaatggaagccggtgcggatgctgaagctgtcaatcgtattgaagataccatcacgttaccagtcgcacggttgtcggcctacgtttatgaacatctgacacagttggattcgggtgcagcttacgttattttaacgaatgcgattctcgattcatttgcaatcggtgatgctagtactgctggggttgtcccattacctgggcgtattgatacggttaagtgctgggcgatttttgttcaacaaaaggaaggtgacttccgtattcggttacgttcaaagggaccgtcaatcaacggtgtggccaagaaccatgatggtgggggccacgcattagcgagcggtgccaaggctaaagaccaacaagaaattgaaacggtagtgcgagaactcgaccaagtcgctagccattatgagaaagaggtttaaatatgaccgcaagttttgaagattttaaattgcagccgttcttgatgcaggcactgactgacatcaatttccgcaaaccgactgcggtacaggaaaagttgattccagtgattgctgctggccgcagcgtcatcggtcagtcagcaactgggagtggtaagacgcatacgtttttactgccaatgatcaatcaactgaatgctgatgaacgttacgtgcaggcagttatcacaacgcccagccgtgaattagcttatcagattcagactgctgctaaacagttgatccaacacagcccgaaagccattcacattggactctatgtcggtgggactgataagcaggaacagattgaaaagctaaatcggcaccaaccacagttgattattgggaccccaggacggattctggacttaatgcgctcccaggcactcgatgtgcatcgtgcgactcagctagtagttgatgaagccgatatgacgctagacttgggctttttgaacgtggttgaccagattgctggccgaatgcctgctgatttacaaatgttggtgttctcagccacgatgccacaaaaattaacgccatttttgcgcaagtacatgaacaatccagttatggaagaaattccagtagaatctgtgattagtccgactattgataactggctgatttccaccaagagtcacgataaaaacagtattatttatcgcttgctgacgattggtgaaccgtatctcgtgttgatttttgctaacacgaaggaacgagttcaagagttgacccattatttgcgccaacaaggtttaacggtcgcaatgatccatggagatattcaaccacgtgaacgaaagcgggttatgcgcgacgtccaacaattgaagtatcaatttgttgttgccactgatctagctgcccgtgggattgatattgaaggtgtttcacacgtcatcaatgatgatattccgaatgacttagaattcttcattcaccgtgttggccggaccggccggaatggaatggcggggactgcgattacgttatatagcccaggcgaagaagccaaggtcagtgcagttgaagcaatggggatcaagttcaaaccgaaggcgattcgtgatggtgagattgtggattcatatgaccgtaatcgtcgggctaaacgggggccaaaacaggaaaaactggacccaaccttgattggttacgtcaaaaagtccaagaaaaagatcaagccgggttacaaacgccgcattcgtaaaaagatcagcgataaggcgcggatggaccgccgcatcgaacaacgagcggctgcccgcaaggaacgcaaggatcgtaagtcttaattgacgtgcatccggatagattaatgcaaaataactgagtggtgtattgacaagtcgccgcaagttttctatactttgcaaagtaaggacatatctatctcacatatcggtcaagaaacactttggttgctggaaaaagtgcggtgtggggtagatgctacctagaagtaatgactagcaaactagtccgtgtctcagcgttaatgagcttaagaggtaaacgaacacatcgttgcaagcagagtggtaccgcgttaacagcgtctttgctagcaacggtgtttttttgccttaaattaagaatgatagagaggatgccagaattaaatgaaaaaattaagtagtagtgaaattcggcaaatgtacttggacttttttcatgaaaaaggtcatacgattgtccctagtgcatcactagttcccgtggatgacccaacgttattatggatcaactccggtgttgcaacgatgaagaagtactttgatggctccgttgtgccggataacccccgcatgacgagttcacagaagagtattcggacgaatgatattgagaatgttgggcggacggcgcggcaccacacgttgtttgaaatgcttggtaatttctcagttggtgactacttcaaaaaagaagcaatcagttgggcctgggaactcttgacctcaccaaaatggtttggctgggatcctgacaagttatacatgactgtttatcccaaggacacggatgccgcgaaattctgggaagcaactggcgtgaaaccagaccacatcattaaagtcgaagataacttctgggacattggtcaaggcccatctggccccgattcagaaattttttatgatcgtggcgaagctttcaataatttagctgatgatgacccggaaaactatcctggtggcgaaaatgaacgttacttggaagtttggaacattgtcttttcgcaatttaaccacactcctgaaggtacttacgaaccactcccacgtaagaatattgatacggggatggggctagagcgggtcgtttcggtctttcaaaatgcgaaaaccaattttgaaactgacctattcctcccaattattcataagacggaagaattaagtgatggtaagcactacggtgataacgcccaggacgatgtgtccttcaaagtgattgctgatcacgctcgggccattacgtttgctattagtgacggggccttaccttccaacgaaggccgtggctatgtcattcggcggttgattcggcgggcaatcctacatggtcaaaaattaggtttgaaagaagctttcttggaccaattggtaccgattgttggtaaaatcatggcctcacactatcccgacgtgctcaaaaatagtgcgtatatcgaaaagatcgtggcttcagaagaaagtcgcttcaatgagaccttgaatgatgggttgaatctgttaaataacttgatcgcggaaaccaagcaggctggtcacgatacactagctggtaaggatgcatttaagttatatgacacttatggcttcccgttcgaactaactaaggaatacgctggcgacgaagatttagatgtcgacgaagctggttttgaagttgaaatgaaggctcaacgtgaccgcgcacgcaatgcacgtagcagtgccaagtccatgggcgtccaacggagtctcttgatcgacatcaaaacgccaagtgaatacgtgggatatgacgaattaacgaatgtgcaggggactttgaacgacattattgttgacgagaccctggttgatcacgtcgacagtggtcaagctgagatgattttcagcaagacaccgttttatgctgaaatgggtggtcaggttgccgaccgtggtgtgatcttagatgatgccggtgaaatggtggctaaagtgactgacgtacaaaatgcacccaacaagcagcatttacacaccgttgaagtgttgaaaccaatgcgaaaagacgcgacttatacgctgaacgttgacttggcattccacaacaaagtcgaaaagaatcataccgccacccacttgttagaccaggcgcttcgtgacgttctcggtgaacatacgaaacaagctggttcacttgtagaacctgattatttacggtttgactttactcactttggtcaagtgactgacgaagagttagctaaagttgaacaaatcgtcaatgataagatctgggcagcgttaccagtcagtgctattcaaacggaccaagaaactggtcacaagatgggcgcaattgcggttttcactgaaaagtatggcaaaattgtgcgggttgtttcaattggtgattattctatcgaattcgatggtgggacccacgttaagaacagtagtgaattggggctatttaagattgtttccgaaacagggattggcgctggaacgcggcggattgaagccgttacttcgaaggaagctttcgaactgcttgccggcgaagaacaaaccttgaagcaagttgctgctcaagtcaaggcaccgaagttagctgatacgccagccaaggttagtcagttacaagccgatctcaaagcggaacaacagaaccgggccagcctcgaaagtcgcttagccaaacagcaggctggggcagtctttgatcaagttgacgatgtgaacggtacgacgttgatcgcccaacaaattgaagtctctggcatggatcaactccgtcaattggccgatacttggaagaccaagcagtattctgacgtactggtacttggaacagtcattggcgaaaaggtcaacttattagttgctgttagtgatgacaaggtcaaggcaggtatcaaagctggtgacttgatcaaagccattgcaccaaaagttggtggtggcggcggtggccgcccaaccttagcccaagctggcgggaagaagcctgctggactaccagcggcgctgaaagctgcgcatgagtggcttgccgaacaataagactgattgctttggttgcacatcctgttttttatgttggttagctatgttaaagctatcaaaataacaattaaatcagtgctgttaggacgagaccgttctaacggtactgattttttaatgttatggcaccttgtgaccggcttaactcgtagaagattgggttacaaagggtgtgcctgttttgaatttcaactattcgaacattcgaaacaggggtatgtcagcatatgaaaaaacagtgtaaatcgggatggatttgcagaaaacgtctgcattctccgggttattattacgaatgtgttacatcaaagtggattgattgtacttcatatgggcatttagtaaaatagattagaagcggaaactagcgggaggtgcttgatatgagttcattagacaaaacaatgtactttgacttcgataatgacagcgttaaggatgtccacgacacgttaacgacagtttatgaagcgttacaagaaaagggctacaatccgattaatcaaatcgtgggttacttactatccggtgatccggcgtatatcccgcgcttaaaggatgctcggaacttaattcggaagcatcagcgcgatgagattatcgaggaacttgtcaagtcttacttaaaggcagataaggatgttgatgcatgaagttgatggggttagatgtaggttccagaactgttggcgttgccattagtgatgcttttggatggacggcgcagggcgttgaaattattcgaatcaatgaggatgctgaggaattcggaatcgaccgggttgctgaactcgttgaagaattggatgctgggggctttgtcctagggctaccaaagaatatgaataataccttgggaccacgggctgaggcggcgcaacattacggcgagttactgacagcccggtttcatttgccggtagactttgaagatgaacgtctgacgaccgttgaagctgaacggatgttggttgaagaagctaacacctcacgtaagaaacgcaaaaaggtgatcgacaagctagctgcaagtttaatcttgcaaaactacttggatcgccacggcaaactcacacaagaatagcgaggaactaacatgagccaaaaccaagatcgtaaagacaatgatgtgatcacattagttgatgacgaaggtaacgaaaccttatttaatattttgttcacgtttgattcagaagatttcggtcactcctatattttattatatccagctgatgctgcggccgatgatgaagttgatattcaagcctacatctttaatcctgaagatggcgacaatggcgaattacaactgatcgagtcggacgacgaatgggatatggttgagcaagttttgaataccttcttagccgatgacggtggcatgcaatagtcgaaagtagattaagctcgtgggcgcatgtccgcgggcttttttagaaattatgagacggttctaactgtcgcataattgtgataaccatgctagaatattaattgttattgaaaggaagcgggatgttgatgactgctaacaagcgccgctttaaagcggaaattgatggtcgtacttacacgatcattggcacggcatctgaccgtcacatgcaaacggtgacgcggatgatgaatgagcaagtggcacaattaaaaaaattagcccccgatttgtctgatacggagattgcgacgttgctcgcattcaatgcgatttcagatcaggttgacaaacaagctgaattattgaaaatgcaaacggatgatgccgacaagtaattgcattgtccgtttttttgcggcttttcgtaattcattggaacttcggagggatatcagtgaattccaaagtattgaatacgttagagtaccaacaagtaaaacaacaattagcaccatacttagtctcggcaacgggccaacaagcactcaatgaactacacccaatgaccagcgttgcggatattcaacgggccttagatgaaaccaacgatggggcagaagtgtatcgtttaaagggtggcattccggtcgctcgtttagcggatataaaaccgcatatgaaacggttagctatcggtgcgaccctgaatgggagtgaactcgggcaagttgggcgggtgttacggacaacgcgcgcaatcacgcgcttttttgccgagttgctagaagatgcccctgagaatgatattcgacacctgtttgatgaagttgcagaattagttactttaccagatgtgacgaagcgcctcgctactgccattgaaggtgacggtcatatcacggatgaggcgtcaccagaactgagccggattcggagcaatatccgtcgtactgaaacggagattcgtaaccaaatgggtcattatacccgtggccatgatgccaagtatttaagcgacccaatcatcacgattagaaacgaccgttacgttatcccggtcaaggccgagaatcgcagtcggtttggtggcatcgtgcatgatcaatcagcgagtgggcagacgctctttatcgaaccccaggctgtcatggcgatgaatgaccggttacggcaaaatcaagttgcggaaaagcaagaagaacagcgtatcttggaggaactctccaacttgattgcgccttaccaggacgaaatcattaataatgcggcgattcttggacatttcgactttatcaatgccaaggcgcgttatgcgcatgatatgaaggcgactgaaccggccgtttcacccaaaaatgaagtctatctacggcaagcacgccaccccctgattgatcctcgcaaagtcgttgccaatgatattagtttaggtactgattatcaggcgatggtcattacggggcctaacactggtgggaagacgattacgttgaagacgctgggattactacaattgatggcccagtcaggattatttattcctgttgaagccggaagtcgcgttggcgtttataatgagatctttgcggatattggtgatgaacagtcgatcgaacagaatttaagtacgttctcatcccatatggaaaatattgaaagtttcttagcgcagatcgacgctcacagtttagtactcgttgatgaattgggtgccgggactgatccgcaagaaggtgcggcactggcaatcgcaattctggatgccattggggccaagggaacccaagtcgttgcgacgactcactacccagaacttaaggcgtatgggtttaaccgacctgatacgatcaatgctagtatggagtttgacgaagaaacactcaagccgacgtaccggctattggtcgggattcctggtcgaagtaatgcgctcgatatcgcacagcggttgggcatcccgcaagcgattgttgatcaagctcggtcgttgacggatacggatagtcaagacctcaacgcaatgattgcggatttggtgacgaagcgcaaacaggttgaagatgaacaactgcatctgaaaacccaagtggcagattctgaaaaattgcaccggcagttgaagagcgaattcaatgcgtatcaacagcgtaaagatcagttgatcgaagatgccaaagtgcaggcgaacaccattgttgagcaaagtaagactaaggccgatgctatcattagtgatttgcgtaagaaacaattagcgagtggtacggcgactgtcaaagaaaacgagttgattgatgcgaagggcgcgttgaatgcattggagcaacagcctaagctcaagaaaaaccgtgtattacggcgtgccaaagcccaacatgattttcatgaaggtgatgacgtgctggtcaaatcgtatggtcaacgtggtgtgttgatgcgtcagatgggtaaacacgagtgggaagtccaactcggcatcttgaagatgaagattagtgacggtgacttggaacgcgttaagccagaagagccaaaacgcgcgcgtgctactgttcagagtgcccacgcgagtcacgtttcgccgaacttggacctgcggggtgtgcgttatgaagacgcgatgactcaagttgatcgctatattgatgctgcgttgttggccgggtatccttccgtcacaatcgtacacgggaagggaactggtgctctacgagaaggcattaccaactatctcaagtctaatcggcaagtcaagtcgtttcactttgctgcgccaaatcatggcggcaatggtgcgactgaggtgcagttcaaataaccagtgacgagtgccaggtgcagatcagtgatgacgcgaattcatggctgtgcacgatatcggcgctttgattgcaggcaaattgtttgtgttccacccggttactggtatacttactattagtaacagataaagcttaaaggaggccgattataatggtcgcagcaactactgataaaacttttacaacggatacggcttcaggagtaacgttaactgacttctgggcgacatggtgtggtccttgccggatgcagtcaccagtggtcgaacaattagctgacgagatgggtgacaaggtgacgttcaataagatggatgtcgacgccaaccctgaaacggccagcaactttggtatcatgagcattccaaccttattagttaagaaggatggcgaagtggttgataccttagttggctaccattccaaggaacagatccaacaaactttagctcaatatctataataagctgggccattatttcattaatggttcgctagcgaacgcgccttcttaagtgaacggcgcgtttttttgcgctcttttttaagaccggggacaaccgttaataatgactatataaggaaaactatttaacgttgcaaaaaagggcgaccacgtggccgtcctttttactgtgcttcttcaggttgttcgtcatcaagttcaacttgaggccgcacgatttcgattggtgttgcgggatcgtgattgacgattggttgattgtgatcaatcgtaactgagatgcgcagtcgcatgcgattttggaacgtaattttagcttcactcacacagttggtgcggagcgccgactgctcagctagaaagccagtttcaagcataaagtctggtgatttgatcgtggcgctacgccgagcgaccggctcaccagtcaattcatacgtgattagatcatccgtcgttgtaatcacgacaaggtgaccccagccggtttgctcaaaaaaggtaacaagatcatcatcactagcgacaggaaactggcgtgccaagtctttacccgcccagtaaaggatgccactactgtcatcacccaataactttggtattaaggcatctcgcaagatttccacactgaggatggaagctttgatcgagttgcccgcaaattgagaataaaagtcgttcgtcatgataattcctttccatgcaaaaaatcgtggtactctagccactgtataatcattattataccccgtttccactaatgtgtcggtttttttcaatttatcaacggaaactttacaatttcgtcgcaattggtctggcttgaaatcaatttcaaaaaagaccataataaagtttcagaattcagtgaacggagattttaaaatggcaaatgaacatgcaattggcttcatggattcgggggttggcgggttgactgtcgtcaagcaagctttgaaacaactcccgcgcgaaacagtttattttattggtgatcaggcgcgtttgccatacggtccgcgaccagctgaacaagtgcgaactttttcttttcagatggcggatttcttaatggcaaagcagatcaaaatgctcgtgatagcttgtaatactgcgaccgcagcggcattgccggcgttgcggcagcagttgtcaattcccgttattggggtgattgcgcctggttcgcgggctgcgttaaaagcttctcatcgtaatcgaatcggtgtgattgcgactgaggggacgattcgtagtaatgcttatcgagatgctatcttaaccaaagatcctactgcgacggtcgtttcgcaggcgtgcccaaagtttgtgccgttggttgaatcgaatgagtatcaatcaacggttgccaagcgggtggttgcggaaacgttgaaacaactaaaaaaacaagacgttgatacgcttgttttgggctgcacacactatccattattgcggccacttattcaaaatgtgatggggcctggggtgaccttgattgattctggtgccgaaacggtgaacgatgtctcggcggtactcgattacttggatattgctaacgatcgttctactaagcgttatccggatgagtactacacgacgggggcggctgatcaattcgaagcaatcgcgcggaactggttgggccaaccggactttcacgcacaacatattgatttagggagtgaagcgaatgactaaaccacaaacattgatcattgcgactaacaatgccaataaggcgcgcgagtttagcgcgatgttggcaccgtatgatattaccatcaaaacgttggctgattttccaaatattcctgaaattaaggagaacggtatcacgtttgaagaaaatgccactaaaaaggcgacggttgtggtcgaagcaaccggattaccggcaattgcggatgattccggcttgatggtcaaggcgttgcacggtgatccgggagtgttctcggcacggtatgctggtgatcatgatgatgctgcgaataatgccaagttgttagccaaccttggtggcgttcctgaagcggagcggaccgcgacttttcatacgaccctggttgcccttaaacccagtggtgagaaacttgtcgttaacggtgagttagccggccgtattctgattgccccccgtggtgacaatgggtttggttatgatccgttattttggtcaagtaagtttcaaaaatccttggcggaattgacgccagcacaaaaaaatcaaatcagtcatcggggtgcagccttgcgacaactgatgactaaattcgatgaatggtgggcgaaagcatgaaatgtttagtagtgagtgatagccatggcgatcgtgacgtgttagttcgattgcttgataagtaccgcggtcaggtcgacgccttttttcactgtggtgattctgaattaccgcatgatgacgcggtttttcaagagatgttcacggttcaaggaaatatggatttcgatgccgtgattccaaatgaagtgaatccaactattgatgaggtgacagtctacatgacgcacggtcacttagtcggtgtgaacatgggattggaccatctattagctaatgctgaggtgcacaatgcgaagctggctttctttggtcacacgcatcaactgggtgttgaacgacgaggcggcgtggtcgtgcttaatcctggtagtattacttatccgcgtggtgaatttgcacgtatcggtggcacctacgccatcgtgacaacgtcagccgcaggtatcgacgtccaatattatgatcggcaactacaagcggtgccagaactaaaatttcattttgctgattaaaatgtggtaaaaaaactgatttttagggctgtgcaaagtgcttttgcggttaaaataaagggatgggcttagtgaaggaggcgctgtatgttaattcaaccagttgaggacttattgtcacgtaacgccgaccattatttgattccggcggacgtggttgccaacgttcaaactgataataatttgtatcacgcgtttttagtactaacgaaggtcaagtattccaaaattccagtacttgatcatggtggtcactttgaaggtttagtatcgttgccactgattactgaacaaatgttaggttttgatcaactgaatactgaaatattactgcaaaaacgtgtctgtgacgtaatggagacacaagttaagacggttcatgatgtggatgacgttgaagagacgttacacttgatgattgataatccgtttgttccagtcgttgatgaacagcaaatttttcaaggaattgtcactcgtcgtgaattcatgaagagttttaactttctgacccatgaaatcggcaaacaatatgatatgattgagaaggatttttccactagtgaaaaagctaaataaatttttggagggtctccgatggcaaaattagatgcacaatcaattattaactacattggcagtgcgaaaaagaaaacacccgtaaaagtatacgtgaagggtgctttagaccaattaaacgttccagcaggcatcaaaactttcttcagtggcaacgctggggtattatttggtgactgggcggatgttgaaccgttcttaaaggctaacgctgcaaatatcgaagattatgaattagaaaatgacgcgcgcaattcagccgtaccaatggcagatttgaagcaatacaatgcgcggatcgaacccggtgcgattattcgtgaccaagtattgattggtgataatgccgttatcatgatgggtgcggtgatcaacattggtgccgaaatcggtgaaggctcgatgattgacatgggtgccattcttggtggtcgcgcaattgttggtaagaactgtcatattggcgctggtactgtgttagctggcgtggtagagccaccttcggctaaaccagttcaaatcgatgacgacgtgctgatcggtgccaatgcggccgtacttgaaggcgtgcatgttggtaagggtgccgttgtggctgcgggtgcgatcgtcattgaagacgtcgctcctaacaccgtagtcggtggggttcctgctcgtaagttgaaagatattgatgataagactaagagcaagactgaattaatggcagaattacggaatctttaatggtggagggataaacaatggtcttacgggaaaccgatctaattccaatttatcaacacttacaccaaattccggaaatcggcttacaagaacatgaaacacaggcttatttattgtcgattattggtaagatgcctcaagagtggctgacaatcaaaaccattcctactttggatacggcgattttagtgaaagtcagtggtttaaagcatgattatcgaatcggttatcgaactgacatcgatgcgttaccagttactgaaaatacgggcttaccatttgcatcgacccatccaggtgtcatgcacgcgtgtggccatgatattcatatgtcagtcgcgctaggaatcctaagctactttgcagagaaccgacctgcgaccgacatggttttcatgttccagccggctgaggaaaatgcctcgggtgggcaacgcttgtacgaaagtggtgcgctagatggtgattggatgccagatgagatttttgcattccatgacaatcctaatttaccaactggagcgatcggttgccggatgggcacgttatttgcggggacttgtgagatccacgcacacttaagtggtaaaagtggacacgcggcttacccacatcaagcaaacgacatggtcgtcgctggtgcggcgttagtctcccagctgcagacgattgtagcgcgcaacgtggacccgattcaaagtggtgtggtgacattaggtcactttactgctggcacgattggcaatgtgattgccggtgaggcccagattgacgggacgatccgagcgttgacgcaggagatgaacatgcatattcagcggcgggttcggacgattactgaggggattgcgctcgcctatgactgcaatatcgatttgaagctcaatcaaggtggttattatcccgttgagaacaatgacgcaatcactgctgattttatcaagtacatgcaggatgatgatgatgtcaactttattgaaacggaaccagcaatgactggggaagactttggttatttgattcatcagattccagggacaatgttctggttaggggtcgacagtccatattcgttgcactcggaaaacatggtgccgcacacggctgccattatgagtggggtcaatgcgatgaccggctttttgactcatcggaatgcgttacacaaataaattacaaaacgtactgcgctaacacgtgtcagtacgtttttgagtttcaagaatgcagagcgttgctgcaattaatggttggttgtgaccgcacaatagttttcgcctggtcacgttaggttgcgaatgggaataactaaaactattcctgacaataacaacgtgcgtcatggttcccacctgaagaaatttgtcagatgaaagatcaagcccgcaccgtggcgctcatttctgagcaaccgctgtgcgggcttgtgttggttgagcttacttgtgcgttggggcgatatttaaacgtggcgaggggagttgaattcccgctgctcgggccgcgttcaagtaggcggccaaaaagtcgcgctgaattgcgaactgcatgccatttttgacgtaaaattgtactcggaagaccaacgtcccatcggcttgtgtcgtgacgccttgaatgtcgggctcaccgatgatatcaggatactgaggcacgaggtcggcattagtttcgcggaccacgttagtcagatcttgaacgggagtcgttgtgagaatgtagaggtcaatcagcacgcgcatatcgttacgcgactggttgctaatgattaaaatcttgcgattgggaataaagttcaacgtgccatcgggactcgtaacttgagttgtccgtaaaccgattgcggagacggtcccctcaatggtttcgattttgacgtaatccccaacatcaatctgatcttcaagtagaatgaagaacccggtgacaatgtcactgacgaagccttgggcgcctaaacctaacgccacactgaaaatcccagcactagcaatcaacgtccccacgggaacacctaacactgaaagtaccgcatagatgccaaaaaacatgatgacgtaatggtagatatttaatgataatgtaaaaatcgttgaaatccgattattggcagtatcactggtattagcattcgttaaaaataagtggtggatcaggcgttttcctagccgatcaatcacccaaaatagtaaaataaataaaatgatttcgagtagcttgccgccaatattaataataatttgttgccagtcaattttcttagccaacttcatccacaccgaaacttgtttagtcggtgtgtcaaccgctgctaggttaattgaattaaacatatcttcaccctcgttattgttgtctgttcactagtttatcagatttgacgcgggcaaccaagccgtgatcaagttattgcgaccaaatgtgactgggtgaatgttgtaagcacttttttaattgcggtatactaaagacaatgctatgctagttttaatatcatggctgttgaaggaggaattttaggatgattacacacattgcgggcatcattgccgccattgcgttcttattattagtatgctttatcgggatttttttaatgcggattactaaaacgatgggggaagtcaaccgtagtttaaataatattacggatgatgttgacgccttgtcacatgagactgaaaaaatcatggcaaatgccaatgaactcttaaaggatgttaacggcaaagttgcaacaattgatccagcgtttcaagcgatgggcgacttaggtcagagcgtctctgacttaaatgctgcgactcgagacttaacagccaagattggcaagaataatgagaagcggagcaagttctccagcgcaagcaaggtcggcaaagccgcttttgatgtctatcgtaatcgacgttcaaaaaataatagtgaggagtcttaattatgtcgaaaaagggattcttattaggtgttgttttaggtggtgcagcgattgctaccgccgttatgaagatggatgatgataaaaaggctgaattgaaagctaaagcacagcaaggaattgccgattttaaggatcgggcaatcgactatgcgttctatgccaacgatgctgctgaagacttcaaggctgaagctgggcaacaatttgaagatacaaagcgaaaagtggccgattttgctgaccagtatcaagccgctaagcaggaaacgggtgaaagctttggctcaagtcttgaccaagctacggatagtttacggtctgaattagctaaggtcgaagatgatgaaggtgatgatgaagatatcgtcattgatggtggagctgcttatcaaaaagctggcgaggacgagaagacttcagcgcccgtaccagaatcagcacctgctaaggacgcaacacctgcgaagtctgatgatgaatcgacaacggatgaatcgtcaccagccaagtaagctgacagcgataagataggacactgagcaagtgctcggtgtcctatctgcttttgaggaggaatcacattgtattcaatcggagcggtcgccaaaaagaccggtatttcaagttatacactgcgctattatgataaggcgggcttaacgccctttgtgaagcgtgataagcagggccgccgggtcttcaatgatgaagacttggattcactggcattgattcgttgtcttaagcagaccgggatgccgttagaggatattcgacaatttattagttggtgtgccgatggggatggaacgattgatcaacggctagcaatgtttgaagagcaacgccaggctgttgaagcgcaaatccatcaatccttgttgaatttgcaaaaagtcaatcataagattgatgtttatcggcgtgcgagtcaggcggggagtgaagccgcggttgactgtgacgtgctgccactgaaaacgacggcggcactgttagccgaagtggctgattatgaaaccgaacatccgctaccggaataacactaaaagcaagtaccagtcaacgctaggtaaaaaaagagggccgtcacggattatgtcgtgacggccctcttgacgtttttaattaaagatctaatacttttaattcttttggcgtatgggtaaatggcttaaagccttccttagtaacgaccccacagtcttcgattcgaacaccagctacgccgggaatgtagatcccaggttctactgagaagcacatgccttcaacgagtggcatgtggttaccagccataatcgaaggaaattcgtggtcagtttggccgattccgtgacctaaccggtgaatgaagtattcgccatagcccgctttggtgatgatatcgcgtgcgattttatcgacatcttcggctgccatgcctggtttaatggccgcttgagcagtcaagttggcttccagacagacgtcaaagatttccttttgcttggcactcggttggccataagcaattgtccgggaagcatcagaagcatagccttcatacatgacgccgaggtcgaatagcactaattcatttggcttgacttgggtttcgttagttgcaccatgggggttggcggcatgttcaccagcttggactaaagtgtcgaaactcatttccataattccctttttcattaaggcatactgtaattcggcagcaatctgttgttcggtgcgacccgccttgacagcagcaaatccttgttcaaaagcaaagtcggcccatttaccggcaatgtttagtttttcaagttcatcagctgttttgaccagccgtaattgctgaatataaggtgatagatccttatcgaagtgggcagctggaaattgctgtttgagcgcggtaaagcggtctaacgtcaagttcccagtttcaagggcccaaactttaggatcagtcaattgtgcgtgaatgtgatcagcaattagcgcgtatggatcttcatggtcgaggtagccgaaaactttgtaaggccagcccatctccttgattgcttcaacttcgagagcgggtgcaaagagaaatggttccgcatccgcgaaaacaaacagtgctagcgtccgttcgtaggggttgctctcaaaaccagtcaaatatgaaattgtgtgaaagttactgatgtaggtcacgtcaacgtgattgtcttgggtccattgacggacttgttgcagtttcgtataatctgtcaattcaaacactccttagataaaataatagataataatactagtatagcgctgttgatgataaaaagctgagaataatgagcccaaaataacaatcttcgtgtggtaaatcttgcattttgaaaacaagtacggtattattttcatgaaagcgatttcaataacaatcttaagttgcattggaagcgtaattttgctatattggttgatgttgcatgaaaacggatgaaaacatatgataccaagcaagaaagggctatttttatatggaaaaacaaacagtaacaatttatgatgtggcacgcgaagcggcggtttcaatggccacagtttcacgagtcgtcaatggtaatcccaacgttaaacccgcaacgcgtaaaaaggtactagctgtcattgaacggttagattaccggcctaacgcagttgcacgagggttagcaagtaagcgttcaactacggtcggggtaatcatcccggacgtgaccaacatttattttgcggcgttagcacgcgggattgatgatattgcgatgatgtacaagtacaatatcattttaacgaactccgatgatgcgggtgaacaagaagtcaacgtgttgaatacgttgatggctaagcaagttgacggggtcatctttatgggtaaccatattgatgacaagctccgggctgaattcaaacgggccaaggcaccagttgttttagctgggacggttgatccgaacaatgaaacgccaagcgttaatatcgactacgctgcagctgttgaagaagtggtcactaacttaattgcacgtggtcacaagaagatcgcgttggctttaggctcattgtcacaatcaatcaacgctgaataccgactgacgggttacaaacgggccttaaccaaggctaagattccgtttgacgacgccctcgtttatgaagcgggctactcatatgatgctgggcggaagttacaaccagtcattgcggatagtggcgctactgcggtattcgttggggacgacgaaatggcggctggtcttatcaacgcaagtatggaatccgggatcaacgttccagatgacttggaagttgtgacgagtaatgatacgattattacccaaatcacgcgtccagccattacctcgattacccaaccattatatgatattggtgcggttgccatgcggatgttaactaagttgatgaacgataaagaacttgacgagaagacggtcaccttgccatacggcattgttcggcggggctcaaccaagtctgctgattaagttcggttgtctgccagctagtgacgttggcataatttagaacgatagcgttatactaggtttggaatatttattccaagccttttttggttttggaatgcgtgaaaggatgagttaaacggatgacacaactaataatgcggccacggcccggaaaaattaagttaggcttgaaggcgtcccaagcacccgcacaattaatggatcgtttgcaataccggcccgaagtatttgaattttttacgagtgccacggactttgaaccggaagcatttcagacacttaaaacagctgtccaatttgtaaagacaactgtcaccgagcaaattgtgattcatcaccctatgagttatcaaggcgttcatcttgatcaattgcttgatccacatcgtgaagctgcggcgtaccaattcctgcaaacgagtacggcccagttacttgcgttggcgacggaattggatgtcaaggtgctcgtacacggtggctatggtagcgacagtgggcgcttgatcgataagtatgagtccttgcaggttgcacgtgacgtggtctttgagcggttggataatttggttcgtcaggcgagtggacatgtcgtgattgaaaatggggtaacggcaagttttatgtatggtgatccccagttagatgagcgtatcattcagcatcattatccgctggtttgtgatttgagccacgtcttcattgcgctgcacggtgatatggaattgaccatgttggctttgaagcggctggctccactcattcaacattatcatttggttgattcgatggggacgcggcacgatagtttacctttagggcagggactgattgactggcagcgggtgttaccagtcctcaacccgcacgctaccatgatttatgaagtgccggatgaaacggatgcgacctgcgctaacatgttgagtagctatcactatctacgcgcactcgaactgcggtcgatcgagggagggcaagcgaatgactaacttagtagtccatgtcgacgagccggctaaggtcgcaacggccataagcaatgtgcagaattttttggcagcccggccaactagtacggtggtggttgtggtcaacgggcccgctatcacgacgctggtaactggtgcctggaagccattacagcagacgttaccgcaagttgagattgatgcttgccataatgccatggtgagtcatcaaatgactgcggcccaacttcctgccagtgtgacggtcgttcccgctggtgtggtgcgaatcgtggacttgcaagctgtgggttacgcatatttacggccataacaccagtttgtcgtggttgtggttgtcattagcaaactgaaatttcaaatctgaaagagagtccaataacgaaactggttcattagatttgcaataaaaatcgcagaacttggacgcccttggttctagtgcttgaaatcgctcgctttttttgctatcatactttacgtatgtttatctactaaactgaaaataaatatgaaagaaggagtcacacatgtcaggacattcaaaatggcataacattcaaggacgtaagaacgcccaagatgctaaacgtgggaaagtctttcaaaagatttcccgtgaactttatatggctgtaaaagccgggggtcctgatccagattctaacgcgcaattgcggttagttatggataaggccaaagctgccaacatgcctaaagacaatattaaacgggcggttgataaaggtagtggctccggtgcggagaactacgaagaagttacttacgaaggctacggccctggtggtatcgccgttctggttcacgcattaactgataacaaaaaccggactgctgctgcggttcgttcagcgttcacgcatcatggtggggctttagccgcaactggtgcggttagttacatgtttgatcgtaagggttacatcgtgatcagtcgcgaagatttagataccgacgaagatacgatgttgatggacgttttagatgctggtggcgacgatttacaatcaagcgacgaagcgtttgaaatttacactgatcctaaacaattagctgccgttcgtgatgccctcgaagctaatggttacaagttggaaacagctgaattaaccatgattcctgaaaacctaacggacgttcctgctgataaagtggaaaagttacaacacatgattgatgaattggaagataacgacgacgtatcagaagtatacgaagctgctaactacccagattaatgatgaaaagacgtggttctttgatgataaatcaagaaccacgttttttattgcttaaaatattagtaaaacaagtgcgtcgaacaggccagtttgctaaaattagagcagttgaatactgaagggacgaataatcatgaataaagtaaccgtactaggtagtttgaatgttgattcgattttgcgtttcaagcgttttcctaagcctggtgaaacgctaccgctgactggtaagagtgtcgctggtgggggtaaaggggctaaccaagccatcgcagccgcgcgcgctggtgcccaaacgacttttatcggtaaagttggtactgatcaggaaggggcctttatggtgcagcagttgacgaatagtggtgttaatgaccaatatgttcaacatagcaatgtggctagtaccggctcagctttcatcttgttagatagtagtagtgagaaccgtatcttaatcgatggtggaactaatcagcaggttacggccgaagatgtcgaacgggcccaacccgcaattagcgctagtacttttttgattgcacagtttgaaacgccgattgcagcaacgattcgagggtttgaattggctcaggccgctgggcaaaaaacgattttaaacccggcaccagctacgacgacggtgcccgcagaattactagcgacgaccgacttaattgttcctaacgaaactgagacggaaaccttgactggcgtgcacattactgatgagcaatcgatgattcagggcgcacagaagttgcaggcgctgggcgttgctaacgtgatcattaccgttgggagtaaaggcgctttctggatgcgcggtgctgagcacggcttcgtcccagcttataaggttgaggccgttgacacgactgcagctggggacacctttattggtgcactcagttcggtcttaatgccagactttagtaatttggccgctgcggtacggtttgccaaccgggcatcttcgatagctgttcaaaaattgggtgcgcaaccatcgattccaactaaggaagccattgaagcggctgagcgggcctaacgccttaattggtttatatcggggcgcttataacgccgtatgttaggattgcaaatgaaaatatgcgatgacgagctgttctggaaataatttgttatttctggaacagcttttttgatgccaaaataaatgtcatttttttcgtggaaagtggtcgttgttacgaaactaatgattgaaaggagcgtgaccatgataaatggtgattgaagcagagttgaacgaaatcattcaggcagccgtgaatcagcgggccagtgatatttattggttacccacggcagaagggtatcaggtgttagtgcaagcagcaggcagtttgcgggcacttactcagattacaactgagttggcccagcaattgatgaatcacatcaaataccgtagtaacatggcgattagtgatcatcggcggccccaattaggggcgatgacgttaacattggcagagcaaactttaaatttgcgaatctcggcagttggcgactttttggaccgtgagtcgttggttgtccggttattgtatgaaggtccggcccgaaaattgagctatttggtcccacagcaacggcaacaattgagtcaattaatgcgacgaacgggattgatcttattttccgggccgatgggttctggcaaaacttccacgatgtatgatcttgtgcggcagcttcgtggccaacggctagtcatgacgatcgaagatccggttgaaatttatgaaccacaatttttacaactacaagtaaacgcaccggcccagatggcgtatggcgatttactgaaggttgggttacgccaccatcccgacgtctttattattggtgagattcgtgatgccgaaacggctcggattgcggtacaggcagcgctaagtggtcacttagttttaagtactattcatgcgcgcggtgtctacgggattattccccggttgacgcaattgggagtggaagccgctgttttggagcaggctttaactgcaatgtcctatcagcgcctcgtaccagtgacgaatggcagcgtggcgacgattttcgatacggtcgtgttaccgcatgcaatgcccaaaacgtcgcaaatgatgactgaaaggtgggcggagttaattgatgaacaattggcagcgggccgtctcgatcatgcgacggccaatcaacttaaggaagcgtaaacggcttccgattgctatgcaggcgaagctgtttgaaacgctagccgacttgctaggcaacggcttctcgtttcagcaagcctttcaatttacattggatgtagaaggaccggcctttcaatccttgcagcccgcgctggggcgtttagccgcgggtgatgatttgtctatggcgctgcgtccatacattgcggtggacttgtattaccagttcttaattgctgagactcatggtgaattacgccggaccttgatgcaggcaggtcaattaatgcgagcgcgtgctgaacagggacgccaaattcggcggttgttacagtacccttgtctgctgttaattctactgctgggaactttaggcacggtcaaagctgcgattttaccgagtcttgctcatggtggtaatggtagtgggacaatcgcgaattggcaatggtttagcggtatcacggtcattaccttggtgatttgcttattgctggttggccttcaagttagccgattacccattcggcggcgctatcagtggttggctcaagtccccttgattggtcccctgatcagaaactactgtggttactatttaagccttaatgcgggtatgctgctgactggtggtttagggattcgtggcatttgtgaagtcagtcagcactttcaaactaaggcgctgatttatcagcaagggcaggttatcgaacaggcgttactgactgggacttcgttagtcacaattatccaggaggaccgattattacctgatgagttagcactactggtcggcaaagagagtccggcagaacagttaagtcaggaattactatactttgcaactttgcagtacgaacgcttgattcgacagttgaaccggatgattggttggattcaacccatcatgtttggcattattgcactcgtcgttgtcggcacatacttgagtttgttattaccgatgtatcaatcaatgggggagattttaaaatgacattattaatgaaacgcttgatgaaaaaaacggcagcaccacagcgcggttttaccttaattgaaatggtgatcgtattggcgatcatcagtctcttgatgttgatcgtggtgcccaatttgaatcaacaacgtaaacaggcggctggtcgccaacaagaagccctgactgaagttgttcaaaatcaggctgaaatgtatgcgaatgatacgggtaagaccgtcacggatgacgacgcaatgttagaagaacttcggaacaagggatatattaacgatggtcaatataagcaggctaagtcacagggcattagtccggtacggccgcaaccacaaaaagtagttggtggttaagcgacagggatttaccttaatcgaaacggtagcggtcttggcgatcgtggctagtgtggcggtgattgctgtgcaccgttttcccacacggcaacgccaacagaatgcggaacaggctttctggcgggagttacaaacgatgtggcagcaacagaccttaaccgctagtgtgacgggtcagccccaggtcgtgagctttcgtggcacagaagtcgtgacttggggtggcaagcgggggcggcctatcagtggcccacagtggcatctcccactgcctgcaacattaaaaacagagcgcggtcgtgatattcaaatccagaaaaatgggcatccacagctagcagtggttattttcaagtcgcaattacagccgaagcagaaaatcaaactgaatgctttgatggggtggggggcctataaagtcacacatgttaaagacgcgaatgggttttttgatgattgaaacgattaccgctctggggctattgatgggtggtttgattgggtttgaaagtttagagattatgatgcagtcacatgaacgccagaccttgcaggcgattcagacggccagaaaacaatatgaagaccggcaacgtcagcagctattatccaggataccggagcaagcacatgattaggcggcgcggttttacgttaattgaagccgttgtgtcgttagcaatcgtggccgtagtgctgacgacactttttcaggggcagcgcaatttggcccggcgcacccaagtggatttgccaacagtggattggtatttgatgcttcacgagcttgaaaatccagatcaccattttgtggtggaccatatttccgatgagggtggtctgacgccgggaaaagccgttcatttggttaatacggtcaccggcaaacagtatttattgacttattatcatatcctacatcgaatcggattgcgccactatggtggtggtgaaatcaatctgatgcagggcgttcggcaatttcacgtggccgatgatttgaccctgacgatgacgactgataaggggattcattttcaagcccaattactgttaccagatcggaggacaatggtagatgaggaagcgacgcggaacgatcctgctttcggtgattagcttattgttaattggtggggcgtttgaaacccaacgatacgttaattttcagtctcgccagacgttatatcgcttaattttacaatcctatgagcacccttatcagcataattcgctcccttgattggtgagtgaaccccgtgacttgaacttaacgcgtaaaatcagtaatatggttaaggattacagattttgcgggagggtgagtattctggcacaagcagaaaccgagacgctttttcaggtcttagatcaatcagttcaagttttgatgcaacaactatccgtttcttacgtggatgcgctcattgagactggcgataatttattaagccaatctgtacatgttgaggatggcaagccaaatccggaacagacggcagctttaacaaagctctatcaaacgatcgacttaaaacaattggacgccgaaacaattcggcgtgcgcttcagttggccttactaaaggcgattcataatgatcacgttgatccaaaccatcaaatgacaccagattcgattggactgttaacggcatacttgattgctaagttagttggatcgacgactgatttgtcaattttggatattgctgtcgggactggtaacttattaactacggtcataaatcagttgcagacggaccggccacgtccgattcagggttacggagtcgataatgatgataatcagttggcaatcgccgcgatgagcatggatctccaacgatcagcagtggagttgtttcatcaagacgcaattgattccctggtcatgccgaaaacgaccgttgtaattggtgatttgccagtggggtactacccattggatgaccgtgtccaaggttttcaaacgaaagcgacgaatggtcattcttacattcatcatttgatgatggagcaagcgatggctcatttgttaccgggcggctggggtgttttccttgttccaacgacgatttttcagtcgcaagagtctcaaggactgttaaaatggatgagcactgcggcttacctccaaggtctgttgaacttgccgactaacctttttcttgatgaaaaatcacgaaaatcaattgttgttttacagaaacatggacaacgagcccaccaagcaggtaaagtattactaggcgactttccatcatttgaggatcaacgtgcctttcaagcgtttaccgctcaaattgatgcgtgggtcgaccagaatattattcgctaggagtgtgtcgtttggggaagaccattgccatcaacgctggtagttcgacgttgaaatttaagttatttgaaatgccacaggaacgggtgattgcacagggcgctgttgaacgaattggattcaaaacttcaccggtcaatattcgctatggcgttgatcatcattaccaagagaaagccgtagtcgcggaccatttggctgccgtgaatatcgttttggatgagttaattaaattgcgaattattgactcatatgatgaaattactggggtcggtcaccgggtcgttgctggtggcgagcaattccatgattcagttttaatcactgaccaagtgcttaagcagattacggatctggccgaatatgcgccattgcataatccggctaatgcggtcggtattcgtgctttcaagcgggtactaccacatgtgcccgcggtcgctgtctttgatacggcgtttcatgcaagtatgccggcggttaactatctatactcgttaccgtatgattactatcaacgatatggtgctcgcaagtttggcgctcatggaacgagccatcgctacgtcgcggtgcgagcagctaaattattgggccgaccgctcgaaacgttgaagctgattacgttgcatttaggtgcgggaagttcgattacggcgattgatcatggacagtcactagatacctcgatgggatttacgccgttagctggtattacaatggcaacgcgctcgggcgatgtggatccgtcgctggttgcttatctcatgaaaaagcttaatattagcgatcctgatgaaatattaacgattttgaatacgcagtcaggcttactggggctagctggttctgcagatatgcaggagctcgaggcacgttatgatgaggactcacaggctcagttagctattgatatttttgtcaatcggatcgttaagtatgtcggtgcttatttggctgagctacaaggtgcggatgcattagtgataacggctggtatcggtgaacgggatgcacggatgcgacaacgaatcgcggatcggttgacctactttggcgtcgcgattgacccgactaagaatcaagtcagtggtgtcgaacgggacctgagtacgaccgatgcgaagattcggacgttactcattcctactgatgaagaacttatgattgcccgcgatgttgagcgcgtggctcagaatcagtgatcagcatcgtttcaatatgattaaggttgtaaagaggcacgcggatgaaaatccgggtgcttttttagatgctgaagtgaaagttattcatgttagtatgcgttgccttcactttattcacgtagcgggagcgttcactggtttagtcaactaacaaagctgaatcccagccatgcaagttagcaaacgcttacgcgtacataagatgaatttcgctagcaagcaatggtatagtccaatcatgtgattttcttaagcgtggccttttgaatgctaggaatttggccgctataataatttcaaggggagtgcaaagataatgacgaaagaaaattcacagcctgcgacggaacaactctcgcgaggcttaaaaagccgccatgttcaattaattgccatcggcggcacgattgggaccggactgttcttaggggccggtcaatctatccacttggcggggccagcgatcctgatcgcatacttagtgaccggtttagtgtgctttttattaatgcgggcgttaggtgaactactgttatctgaccttcatacgcattcttatattgattttattaagcaatacttaggtgataagaccggctttgtggctggatggacgtattgggtttgctggatcacgattgcgatggccgaaattacggctgctggtgagtatatgcagttttggtggcctaggttaccgcaatggcttccggggctgattatcttgattttattgctgggcttgaattctattaatgtctcagcgttcggtgaaactgaattttggtttgcgattattaagatcgctgctatcttggcattaattgctgttgggattggcatggtcttgtttagcgttaagacccctgtgggccacgccagcttaaccaatttggttagttatggcggttttatgccacacggaatcaaaggcttggtgctttccttccagatggtcctgttcagttttattgggatcgagatggtcggcatgacagcttctgagacggctgatccgaagacggtgattcccaaagcaatcaatgatattcccgtgcggatcattctgttttatgttgggtcactattctttctaatgtgtatgtacccgtggcaatacttttcagcggcacacagcccgttcgtacaagtattcaccaatttgggaattcgttcagcggctgcgattatcaacttcgtagtgctcacggcggccgcttctagttgtaatagtgcgttattcagtaccgggcggatgttattctcactaacgtatgatggcaaaagcaagtttgccaaacgaatggggacactatcgacccgccaagttccccgcaatgcgttatggttctcgactctggtgattgggttgtcagtaattctaaacttactgatgcctgggaaagtcttctcgctgattgcgagtgtatcgactacttgttttatctttatttggggcgcaatcgtcgtcgcacatatcaagtatcgacgtcaagcgggcagtcaggctaaagtgaaattccggatgccactgtttccgttatctgattacttcattctagtgttcttagcttttatcgctgttgttctctgtctgaagtttgaaacgttaatcgcgttactcgtgtcagcggtctgggtggttggcttatacattgtcaagatcgttagtgaccgaattcgtcaacggacacacgactagtcagcaataaccaggagtgctgattggctatcaagtaggttaactaatgggatttatgaagtgcacttaactctgccgattgcagttaagtgcactttttgacgatattagctagatttgtgaatatgggttggtcataaaacatggttccagtgctgacaaagcaataaacttaaaactgttctagtgtcttttagaacggtgcgcggtacaatgataaatgactaacgcgttgtgtcaggtgttctttaaaatggttcatgattaatacgtgctgttcagtaagtgccaaaactgtcagctttgactcggtggaaacggtttgtttagtataaacttgccgagttagtgtgccatatgatgactgacagtcgtaataggattcgaatgactgacatgggtacatgctgacgaacggataagtcagcttttcaagcaaaagtcatgaaattcgctagacatgacacatccgattgatgttacaaatgtaaatatacgaataagaggtttgaacgatgcaatattttacgtccgacacacatttttatcatgctgatttgttgggggacaacgactttgcgccccggctatttccagatgtagagacaatgaaccaagcgattgttgaccattggaatgcccgtgtgacggatcaggatacagtctatcatttaggcgatgttgcgctgtattttacgcgaccagcgaaattgtcttatgagcgggtttttgcactcttagcacagttaaatggcaaaatcatttttataaagggaaaccatgattcacgggccttctttaagtatttggctgctcatgatccacagttgaatggtcaaccgaagtttgaatttcacgacgtgggggtactgattaagtacgaccaccgccaatactatatgacgcactacccaatgatgatggggatcgtcaaacaaattatcaatttgcacgggcatattcatcattatgccgtcaacgtcaaggagaacatcaacgtgggtgtcgatacaccagaagtcgattacttggaccatccggtgccctttggaacgccattttcactggccgagatcgagcagatggttgacggtaaagccattgattttgccaagcgccagtaagcgagtgcttgaccgactttggtgaatgctttaggattaacaaagacaacgattgaggggcgattgaccgtggacgagcaagtcacgattctgcataccaatgatattcattcgcattttgaaaactggccacgtattcaacggtatttattaaccgaacgtgagcagcgccggcaatctggaagccatgtgatcacggttgacctcggcgacgcggttgatcgtgcccatccactctcagaagccactcaagggcaggccaacgtggcgttattgaacgcgattggctatgatgcggttacgattggcaataatgaaggactgggtttaacgcacgcggccttaaaccggttgtatgaccgcgccaactttgatgttgttctcggtaatttgacagatactgcaacgcaacgaccgccgcagtgggcattaccagctaaaatcattacaactgcacgggggacacgagtcttgttgctggcatttacggcaccgtttacgttgacttacccgttgaacggttggacgccggccagtgttaagacgcgattcccagagttgttacgacaatatgcagggcaatatgatgtcttaatcgtgatgtcccaccttggtatcaatgtcgatcggtggttagcaaaacagtttccggtgatcgatgttgttattggcagtcatacgcatcatttactggtgaacggtgaactgaaaaatggggtcctgatagcggcagctggaaaatacggtgagtatattgggcgaattgaactgacgattgatcatcaacatcacgttaaagcggccgcggcgcataccgttgccacggccagcttaccaattgtggccggtgatgaaacgttgattactggctgggagcaacagggtgaaacgttactcacgcggcaagttgttgcgaaggtgccgacgcagctgcggccacattggcaccatgcaagtgatttgacggccctcgggctagcggccattacggactatgccaaaactgatctaggtatgttgaacggtggcctgttcatgcgggatcttcccgcaggcatggtcaaccgaaatgatttacataccatgctacctcacgcgatgcatgttattcgagtgacgttaagtggtgaagcattgtggcgcttagtctatgagatggagttagttcgcccgtttttgaacaaatttccgattaaaggaatgggatttcgtggtcaagtctttggttatatccagtaccagggcctcacgtggaaaacgggacagcatacattactagtgaatggtcagccggtcaatcggcaacaaacgtaccagattgcgttattagatcatgatttattcattccgtttttcccgaccattaatatcagtggtcgaactgagatattatttgaagccatgttaagaacggttgttggcgattacttaatgcgtcgatggccggttaaataagagaaaggtggtgtcaatgtgaatcgcgaacatattgatgaactagctgaacaacaagcggaacggcggcgcaatttgtatcatggattacgaactgataagacccactttgaagttagcaagcacccgtttgaaatcgtgtacgattatcgccaagggtttgacctcgacaagttcgttgagcgctacagctcaattttaaataaatatgattatattgtcggtgattggggctttgaacagttacggttaaaaggttttttccgtgatgatatgaaagatgtccagcgctcacagacgattggggcggtccaagactatctgtacgaatattgtaattttggttgcgcctattttatcattaaaaacgaacgggtcattaaacctaagcgtaccagtcgctcacgtaaggatgatcggcggggaaagaaaaacactaatagtcggcaatcccgagcgcggagtaaccgtaacagtagtcgcagcaaacaacggcggaagtctcatagcttcaccactaagcagaaggccgcaccgtttactgaaaagcggcggcaaccggcgaaagttacggccggtaatggtaagcaagcgcaaacaacgaagcagagtagtggtaaacgccactttacgattcgacaaaagtaggaacagagagaggtattttgattgggtaagtacaagggttatttaattgatttagatggaacagtttatcgtggtcgggaacgtattcctgctgctaaacggtttattgaacgactacaggctagtcagactgattttttattggtcacgaataacacgactaaatcaccagaagatgtggctgcaaacttagcgaacaatcacgatattcatgtgagtcctgcgaatgtttatacggcagcgttagcgactgcagactatgttaatgaccttgcaggtgatggtgataaaacgatgtacgtcatcggggaacttggcttgaagggtgcaatgttggaaaagggcttcaagttcgatgagcgcacacctagattcgtaatcgttggtttagactatgatgcgacctaccataaatttgaacttgctacgctggcaattaagcggggggctaagttcattggcaccaacgcggatactaatcttccaaatgagcgggggctagtgccaggtgctggttcagtaattgcgatggtcgaacgggccacccaacaacgtgcaacttacattggtaagccggagacaattattatgcagaaagcggtcgaccggattggtctcgataagcacgattgtgtgatggttggtgacaattatatgacggatatctcagcggcaattaactttgggattgactccttattggtgtataccggtgtctctacccctgaactagtggcacaacaggccgtcaaaccaactaatgagatcaattctttggacgaatgggacctagacgatggtgtggctaaataaatttaaaaatgcggctcagtggctgagtttatacttatggttagtgagtggcacgataattgtaacaatcaacgcgagctggttgtattttgccaatgcggttggtcaaaagttaggcgcaactgtgaatttgacattgggacggctgatgacgaactactatcagctgttagcatatcttaactttccgtgggtacccaaattaactatgaacgattttacggattcgacgagtgcgttggttcactttgcggatgtgaagaatctatttatgcttgattacggtgtgtttatcgtcacgagtgttgtggtctattttttttggcagcgactacgacgtgatcgacaattgtggcggttagtattaccgatgcagacagccctctgggtaccaccagtagtgaccgttataatggctatcaattttgatcagttctttatcatgttccataagatcttatttcgcaattcggactggttgttcgatccactattggaccgaatcattttggtcttgccggatacgttcttcggtcagtgctttgttctagcgtttatcctgattgagtggtcttttttttacttactcagtatcggcagacaagcgttacgtgaagcggattaatgaagagtatttacagtggacactgcattttaagttagattataaaaggccggtcagctattattagctgatcggccttttataattggattaatcttcgttttcagttggatggctaaagcgtgcgcggatagcagagaagacagctggaatcagtgaaaccaggatgattccaatgacaaccatcgaaaagtgttccttaacgaacgggatattaccgaagtagtagccaccaccacaacagagaatgacccacaggacacagccgataacgttgtagcgaatgaattgttgatacttcattcgcgaactggcagctacaaatgggacaaaggttcggatgattggcatgaagcgtgcgatggtcacggtgatgccaccatgtttttcgaagaatttttcggactttgccagctgtttttgattgatcagtctaccaaaccaggatgtttcagttaggcgttctcctagggaatgaccaatatagaagttaagtgagtcgcccgccaaagctgccaccaagaagagaatgacaaaagtccagatatgtaagccataggttggattagcggcgagtgcgcaagctgcaaataaaagggagtcaccgggaagaaatggtaaaatgaccgcgccagtctcaatgaagatgatggcaaagagaattaggtaggtccagattccaaaactattcacgatggtgactaagtgctggtcaatgtgcaacacaaaatcgattaaaaaactcatggttacctccaagtaatgtgaaattaatcctatctaggttaccagaaaatcagtggaaatactatgcttagtcgctaatcgcaagaaatccttacaaatggctagcatttaatcgagttctcttgtattatcaagataatcttaatagaaaacgggtgattttgtggcatttccacaattagatttaagtcaggtcgatggaccaaaagcaacaatcaaaactaactttggtgatattaaggttcaactatttccaaagcaggcccccaagagtgttgaaaactttgttggtttagctcagaagggttactacgatggcattatcttccaccgggtcattcctgattttatgattcagggtggtgatccaaccggtaccgggatgggtggcgaaagtttgtggggtaaaccatttgaagatgaattctcacaagaggttttcaacttgcgaggggcattatcaatggccaacgctggtcctaatacgaacggtagccaattctttatcgttcaaaagccacaattagatgctgggatgagtgatcagatgaagcaagctggttatccggaagaaatcgtgactgcgtatggcaatggtggcacgccctggctagatttccggcacactgtttttggtgcagttagtgatgggatggatatcgttgataagattgcggccactgagactggtatgcaggataaaccagtgaaggatgttgtgatcgaaacaattacaattgaagattagttagtttgaaagaaatctgcggctgcgggtttctttttttgcaattacgattttgcaatccgctgtattcaggttataatattggggattagaattatcgacaatatagaatgaatgagaaaggatggtatgatcgtgagcaattatcgaattggtatgcgggtacacggacgagtcactggtattcaaccatatggtgcttttgtcaccttagatggtgagcatcagggattgattcacatttcagagtgtcatgaaggatacgttaaaagtattacggagtatctaaaggttggtcaagccgtagatgttattattttagatattgacgaatatactggaaaaatcagcttatcattacgttgtatcgagcatcaaccgcatccgacggtcaatgatttggaaatctacaagacttttcggcataagcatttttggacgaatcggcatgttcatgctggctttgaaccaattgccaatcatttagcgagttggacttcggattcactaaatcgattgaaagcgggtgagtattagtgcagaaaaaagttgccgggacaattatttataatgaccagcaagggtcgcactttttagttaagcattctactaatggatacaatttttatcagttgccagtacgagcagggcattcgcccttagcgtcagtattgtgggatttgcgatatacgattggtattgatgttgaccaattgcgcttgtatgattcgattatggctgagctggatgatgaaaaagttgcggtctttgtctttgaccacctagctgttgacgggcaggtacgtgcaaagtttgatcgtcaagggctcgagtttgttctagccagtgaattgcacgagttatttacgagtgttcgtgtgagtgaaacaatgccgtttacgaatttatcaaaataaattcgaataaagggttgacctgcatactaatacttgataatatatatcttgtcgctgcgagcactgctgttaaacagctagccgctagcacttacattgtttcatttcaaattgttgtaagtgaataaatattcaaaacagcaaaaaagttattgacatgagtaatcgctaatgataagatatttcttgtcgcgttaacaattcaactgattgaggcgttaccgattgtgttatgataataacgtttcaaattcatttgcatagttattcaacttcttaaataaagttgttgacaaggaaatgatgaaatgatattatgtaatagttgtgttaagcgattaacgcacttattatattctctttgctactcaaggctctctagaaactcactcaatgcttcctgccaggtcaaaatatggtaaccagtggctttggctttatccaaattcatcactgaatgctgtggccggtaagctttttgtgggaattgttcagaagtaactggtgctacttcaacatcagtgtccttcaaaatttccttcgcaaagtcataccaagtagctgtattatcgttacttaattgataggtccctgaagcggcttcagttttcaccaggtgggccataaattctgctaatgttcgcgtccaggttggccgtccgagttgatcattgacgactgtcaacttgtcatgcgtctttgctaaattctgcattgtgaagacaaagttatgcccaaattcaccgaaaacccagctagtccgaacaatatagtaatcagcaccgctgtgacgaacggcttcttcaccagcccacttagcacgcccatactcattcttggggttggctggatcatcttctaaatattcacctttattagtgccatcaaaaatgtagtcagtagaaacataaaccaatttaacaccctgttcagctgctacttgggctaaattttttgttccatcaacattgaccagccaattgagggctttgccttcatcttcggccttatcaactgctgtgtaagccgcacaatcatataagaccgctggttgtaattcggcaatcttagctttgactgcgtctaagtctgtaatatccaattctttttcagtcagcgcgtcaaatgcaatctcttgttcatttaatagtcgttgtaactcatgacctaactgaccattggcaccaacaatcattactttagccattttcatttcctcctaaaaaataagcgaactgtcaatcgacactccgcttattcaaaatcttctgtgtttttattgcccgttcttggcgtagtttgattcaaccttgttcttatctgcttgccaccagttttgatggtccgtataccaatcaatcgttgctttcaaaccagaccggaagtcagtaaactctggctgccaacctaattccgtgcgcaacttagttgaatcgattgcataacgtaaatcatggccgggacgatccttaacaacatcataagcatctttaggctgacccattaattcaagaatcatttccaagacgtccttattgttcatttcgccatcggcaccaatcaggtaggtctcgccaatcttacccttggttaaaatatcccaaacggccgcagaatggtcgttcgtgtgaatccagtcacgaacatttttaccactaccatataatttcggccgaataccacttaaaatattggtaatttggcgtggaataaatttctcaatatattgataagggccatagttatttgagcagtttgaaatagtggcttgtaagccaaacgaacgcacccaagcccgaactaagagatcactgctggccttagatgaagagtatgggctggaaggcttataccgactagttggtgtaaacttctcgccaacaccctcaccatggcccggtaaatcttcccgtaatggtaaatcaccgtatacttcatcagtggaaacatggtggaagcgtttgttaaacttatgtgcggattgaatcagcgtataagtcccaataatgttcgtttcgatgaatggccatggatccttcaatgaattatcattatggctttcagcggcataatggacaaccgcgtcagtttgttgcattaattcatcaactaagggcgcatcacaaatgtcacccacaactaatttaacccggtcgcctagaatttcttccaagttggcccgattaccagcataagttaacttatctaacacggtaatcttgacttcgggatgatgattataaacatagtgaacaaagttagaaccaataaagccggcaccaccggtaactaataagttttccatgacgtctccttaaatttcgccgtaaacaaacggattattctgttcaaattctttgaaggtctgttgtttagcatccttatcagaagtaatagcttgatcgtagtcaataggccagttaatgtttaaatctttatccataaaggtgattccaccatcagcttcagcattgtagtagttatcacacttgtataagaaattaacattatcagtcaatgtcacaaagccatgggcaaagccacgggggactaacaattgacggtggttactttcagagataatatagccttcccatttcccgtacgtaggtgagccagcacgaacgtccacaataacatcaagcacggcgccagtcactacgcgaatcaatttagtttgcgctgccttgccacgttgaaaatgcagtccccgcaaaacacccgcttcagctgacaatgattgattatcctgaatgaaatcaaaatcaattccagcttctttgaaatcacggtcagagtaagtttccgtaaagaacccgcgcttgtcaccaaaaactgctggttcaataatcttaacatcttgtaacttagtcgttgttacctttaatttgcccaaaatttaagccctcccaattaatcttaataagtattgaccgtaatcattcttcttcaatggttgcgccaattcatacactttatcagcatcaatatagcccatccgataggccacttcttccaaacaagccacctttaaattctgtcgcttttgaacggtagcaataaaactacttgcttcttgtaatgaatcatgggtcccagtatcaagccaggcaaaaccacgacccatgagttcaacatctaactcattatgttctaagtaaactttgttgatatccgtaatctccaattcaccacgtggtgatggttgaatattcttcgcaatatcaacgacttgattatcatagaaatacattcctgtcacggcataattactagctggatggtctggcttttcaacaatggactttgcatgcatattttcatcaaagtcaacgacaccaaaccgttccggatcattgacatggtaaccaaagaccgtggcccccttcggcttagcactagcatgttgaagcatttttgataagccgccaccataataaatattatcacctaaaataaggcagactgaatcatctccaataaaatcagcaccaataataaaagcctcagcaagcccattgggacgttcttgaacggcatatgttagatttaatcctaaatcatgtccgtcacccaacaactccttgaaccgcggtgtatctacaggtgttgaaatcactaagatatcctggattcccgccaacatcaatgtggatagcggataataaatcattggtttatcgtaaatcggtatcagttgcttcgaaatggcgcgagtaattggataaagccgggtacccgatcctccagctaaaattatccccttcataataaatataaccacctatcttttgatttttgctaacagtgatttcaaattaaaaatgtctgcagagaacaatcgtgttgtcactataaaaattacaaacattaatagctcaaatccggcagtagttgcaatgtttaataagatattattgtaatcaacaatttgtgtgctataaacaattacacctaacattcctacgccaattataatataaattatgttcaataacataaactttagataacctttttttagtccccacttgaatacaattaatggttcccaccatagattcacaagcatattgcttgtgattgtaccaagtaaaactgcagagataccaagacctgtgaacttaattaagacaatagatacgactaaattaactaccgactcaaaaatcgacttatatcgtgcataccaataaagtccatacgcattcgtgtatgtaataaccggttgccgaattccctgaaaataaaagttcaaactaatcaaaaacaatggtaactgagtataaatatatctagaaccaatccaataacgaatgaaagtcgacgagaaagcagtaaaaccgaccgttgcaaacaaaaccaacagagtactcaatgcataataattatagaatactcgcttctgcttttcttgactcccacgactggctgccaggttaccaacagatgaagcaacggatgtcactgcctgattaagtacgttggtcaaaccattcaaaattagcgtgtagtttgaatagagtccgaccgcatctaaaccaatgaaatatgataacaagatattatcagtcccattcacaacgataccgcctacttttgaagataacattcccacgatattctttttgaaataactaagtgtattcccgtctactcgttcatccttataatcatttaagtatggatacattttatctacgacatgcgaaacgtgaacatttgagataaccataaagagtaactgaatgaacaaatacaaataaaaattagcatagagtagtaaaaagataacttgaacaatttgttgtactaagctgtacccaattgtattgattgtattcaaatatccctgttgattcgcgatcaacaatgttcgcttgtaactcaccagatacgaggcaactgtattacctagagcaagtaaaaatgccacatacacattaacaaagttagtagcttggttgtgaactaaataaggtaagaatggcgtcaaaataataccaccgattgcaacaattaaggcaatatactgataccatttcttgaattgtctcatcaacgcagcaatttgtggcctattctcagttgctaacggctcatacaacgcatatgtaattgcggagccaatacccagttcagcaaaattgagaaaagtcaaaatattggtaaaaagtccattcagccctaaatattgctgtcccaatatgtggataaaaaatgttcgtgccacaaattgcataaccaaagtcgcaatttgaccaatgcttgcaatactactatttaatagtgctgctcgtgttcttgatagattgtttcgcatcttttttctccttttattgtttgttagcaaacaatacgtcccactatagaatgcgatacaactgtgatagatgtttcgtcaaactaacatcactatccgaataattagtaatcaaaacgactgtactctgagtatcgagattgcttttaattgctaaagcttgtcccgcgacattcccattatacgtgaatacattttcattcaggctaccaacgcctgattgttcaatatagtcttcaaaatattgcgtatacttagaatcgaaaagcctatttttctcaataccattcaatgataaaacaatatcagctaaagacattctcagcgtattaccgttcaggctacgcttcttaatcacaagctttttactctggactctcgtattgttcacaatttttttgtcataacttgccacatcattagtataagtctgtctagcattaaaaaaacgcgtattactcaaaccaaacttattagtcagttcttgttcaaatgtgctttcataactcttagacgttgccctagcaattacaattcgctttataaaagtatcagcagtaacccagtcagtcataccacccttaccctttttaaaaagagtgttactatattctttatttcgtggattttgtattgttgcgattgattgctttcgtacatacaaatgtgactcattacgcaataattgtttaacagttagtctccctactgcaccacttgaaacatcatatttgctgagctcatccgttaacttaacatccccacgatttactaaagacaaaagcagtgcctggtctaggactgtttgatatttaccaacaagaacagaactattaacgttaaatgaagtatttggacttgtgttgctgtacccatttcgccaactgtaaactaacttattgttacgaacgcccaagaaggctccaataaattctcttttactcaaaatacgattgttttcacttaacttttctttatttttgttactcagtcgtacagtatcaagggttgtgcgttcaagcagcgatttttctaattgatgtgatacaactgtctcgcttgtcataacattagtatttgctgcagaaatatcaataattttttttccgatgaaaacagctaccaatacaactgcaaacaataaaaatatgataactgcttttcttgtacgccccttcataactagtcctccaagttaacgtatcccaaaattttattattggaattgcgcttaactgtttccattagtttataaacatttcttttggagatctttttcagttgcaaaacaaagattattccttctgataaattgcagacactatctaaaagcgcaacatcacccacaaaagtaggcgtgttgattaatacatacgtatatttatttttcacttgctcaattagctcattaaatcgtggatcaccaagcaaatacttaacatcctcatttgaagcattacctgatgatacaaaagaaacatctcgtcccggaacactttgaataacatcactcaactcaactgaaggtctgctaatgtaatcagctaatccatactttgatgaaacatcaaagacattcggaaaaatattacgagaaaaatcagtatcaatgatcaatgtctttttacctgcagtaccatacatcaaggctaaatttgcaatcaaagtttgctgcccaactaagccgccaggagttataaagctgataacatgcttggaagaaatttgttcagacagtttttgattaatctgtctaacaacatttttaatatgcgtactcatttagatcccccctttttttcagataacgtaatcgtgcctaacttattaatctcaaatacatcttccacaaaatcctcatctttaattttgccaataaacagctctctagcaataaaaatgagccatgatagaacaaagcctaagatagctgcaactatagtatatttaattaatatttttctgtagccactaatatagcctgtggatgcctcggaaacaatagagacattcgcacccgataaatactggctaagattagacacgagtgtttgcattgcagtattcgttaaaaactccgaaaaatatttattgggacttgcgacacttactgagaaaaatggagaatcactattattgccaattgcgatagtatagtttttgctcgcattactttcttgccaacggcttgcagcaatttttttatccaaaattgtagtaaaactacttgacgcagcgaattgtttataagattgtatcaatgtatagttattatcattttgaaccatctgtcctgttgacgtatacacgttctttttaagtgtcatagtagctgcaccacttaaaccgccaaataagactgcaattagtattgtaatcaatagatacttcttaactaatcgatgtgccatgccactgttaaaccgaaacacaaatttcattttatcctccatacacacttgtatatataaatattgtttttttgcacaataacaataacaattctacaaaaccttcagtcaaagtgcaacctaacttttctattcttcaaatatgttaaatacattcgaagtgtgattgaaattgacaattgtataaattaagttcagtatactgaaatgtatgttttatttatatatctttaattaaagcgaggtcactactgtgaacgacacttttcaattgcgcatacagcaactttatcaatgtttgtatgcagttattgtattcttatcagttctgtcattgagtagctggaatctatatgttccacatcttctgaataccagtgatcgccttatgctcttggtatttggagccactatatttgtcacgctgctatcagaatggtcaaagaagagattagttgcaatgtttattttctcccttctaattattggctactactatctttacaagaaaagtattttcgtattcgtactgcttgctattctcgctggaagtggtatgaaattcgacaaacttttgaaaacggatttgattgcacgaagtatctcggttatattcattattgcactaagtctactgaaagtgctacctagctccggttcaggcgtatccgaaaccaaatttatttatactaagtttacttttggattcacatatccaaatatacttggctatttattagtaatcataataattacttattgcttttctattagtttattaaagaaacaggttttttggatagtacttttaggctgtctaattgagtatttacttaactactcaaccggattgatatctttgattttattctttgtcctctatatttggattcaacgtgatacactccaacgctccaatatcttattactgactagtagccttttaattccagtattcacaattattagcgtttggatagctaaatactactttgcttcgaataattggtgggaccgggtaaatacaattctttcactgcgcccaccaatttggcaatattatttaaaagctatgcccatcagttttttcggtaacactaagtcaatcaatcaatacacacttggtgttgttggccatggtgcttttgacggggcatacattcaattccttcttgaatttggtattctttcaattttgattctgtttattgccgtgttcagcctctattgcttacacctacctgtgcatcaaaaagccactcttggcaccttaattatggtaacctgctttagtggcttccctgaaacgaacggtttcttagttaccttttctccaatgttttttctgattggttcagcttggttcaatactttccaatgtgaaaatgcgcactgtataaattcttcactctaaataaaaatcgccttgccaaaatggtagggcgatttttcactactgagatatatgcaataatcaagataattcggacttctcaaagagaattgaagttaagcgattcgtagccatctccaaagtatacttacgaaccgacctacatccttgtgtcgcaattttaaatagtcgttcatcatttctcaataaatcaactatttcatgtacgaacccttccaaatcatctggatcgactaaaacactattcgtatcattagcatattcaatgattcctccgatacgactcgcaaccaatactgccccagaagccattgcttcagttccagtcaatccccagccctcaagaacactcggcatcaagtacacctttgaactgccatatatttcacttcgaagctgtttaggtgttgcttgataagtaaaatgaacatagtctggtaatggctcaacaggctgatatgccccaaacagctctacctgcaaatcaggaacctcctggtgaacctttttcaacacgtcaagtccaaacttagttcgcttactctcctgtatgtgatttaacaaagctacggtattcttacgcgatcgaatcggttgctcaataaaaaactcttgttcatcatagaaattgggtaaatacgctaccggcaaaccactgactttttcaaccttctgctttaaatctttagaaatgacgatatttgtcattccaaggcgataggttgcttctaaagattcagtattgtcataccaccacgtctcatagctttgaataaaataaaactttctacccgctctatccggcaaagccttaacatactcagcagttaccgcggcggttccaataaccacatcagcatctggaacatcatcataaccgacaacgtttgggttgattctaattttatcatctaatttgaaccaagttacttgttgtgccggaaatgccggctttttcaaacgccatttcacccgcttaagtcgttccagatagaaacaacttgttttgggaatcacacgaaacaaaaaattaattgtgaccgtgtatcctcgtctactgagttcattggcatattggtacacaattttatatccaccaatcggtttatcattggtcgcaggtaggataaaattaactttcttcattaacctgcctcatcatcttctgaaacctaatatctttttgagggtcatatcgcattccatccttaattccccgaaaagccgccctaaatttttttccacgtggtcgctgatataagaatatttctctcaaccgactaacgcttaaccgaaatagccccttgggttcgttaaaatattcgggatatcgtcgatgcacaatgataaagttcttgtagaaataataaatgcgtattggcgaatgatccgaaaaatacccatgatacgcacctaaatgcaacaaatgtccacgtataggcgcatagatggtattgccaatttcatgctgcatgactatttccgtattttgataaattttatacccacaagctagcacgcgtgcatcaaaatcaaagtccacaaaatctatgaataattcatcatccatgccgccgctttcacaccacgcattaaccttaattaacccaccagaggcaatcacatttttcttttcaattactccttgattaacgtatgaatgactgttaaatgccgcggcaataattcctgtatcagactgcttaaactgcgacatggctgtcatacgttggaccaaatctccaggaatcacagagtcctgatcaagtagtaacacccaatcatatgattgagcctgtaatcgcctaaaaccagcattctgtgctgctgcaattcccttattagtatctaaactcagtacgcgctttttacctaccgtatttaatatttcaatcaaattttttgatccattatcgacgattaaataattatcacctacgttagccgaagttgcttttatatttttcttcaaaagtttaacgtccggattgtaggtcacaatgagtgccgcaactttcttcaaatctgagttcaattcttgattttccacaaaacagcctccaaaactatctttcacgtacctatcgcacttaaacctcaaacattttttgattaatttctcccatttttccaaaaagtccgcaaaaaaccgcacttaaaaagaaacgataatttcgcagtccagctttcgtcttaggcatatagacaaaaaatggcattacacaataaataagtaaattcagataaaagattgaattgtttttcttaaacaattgtttaccagtatataccccattacgaatctgatagtatgggcgccataatttgttcacgttatccgtctccaacattaattgcacatcgcttttctcttgaccattttgcttagtattgttttggtaccaggactgttctaaatccacggaaacagcctgtttaaatttaagaattcgaatacctgcccttgacatcattatagtaaaacgagtgtcatccccatacacgtagtataatctttgaatcggttcaagattaacaatatcttgcttttctaatatgatccccgaataaggagcaatataggtttcacaaatttcgcgtatgggacgttgagtatagttcttactactatgaagcttgtgcattactgaaaatttatgcacggtattttcaaagaagtgttcattaacatcttgctctctttgaaatcttgtcacatccatgtcatgctgtggccgatataatgatatagcaatcttctcaccatagacggctcgaacctttttatcatcaagattcttcaaaaaatcaaatgtttcatttggtatatagttgtcatcatctagaatcagcagtttaggtgcaccaattgcttggtacttctcgattcctataccaaatcctccggccgaaccctgattttcagagtttgtaattgttataaatgttaactcaggaatggacaaactttcgacgaaattatgaatattatattcagcaccattctgaacaattattacattttctacaaactctgcatgtttttgtaactttgttagcgtctcccttaaaaaaactcgatgatcctgatatgtcacaatcaacaccgtcaattcttttttctgtaaatatgccattactatatctccatcagatttactaatttattaataattgagcttgcttgaaagtcatctattgaatcattaataacaactatttttttggactttaacaaccgtttcacttttcttagatcatttacatttgaaacacctaccatctcaccaaaatttttatttctgggagaaaatgttccggtagctaaatacatattcttcaacaaccaaattgtataatcgtcagggctacgaaaacgatgcattgaagtttgagtgaaaatttcaggattcgtagtatttaaatctaaaaaccaactcttcaagttaggatacgctaaatggtcctcaaaaaagccaacccagttatgatatattaaattactgattgttactaaaaccgcaactataccataatttcggatatttatgtattttcgagtatgcttccggaaataatcactttttggaaatttctgattgacgaatagcatattattaaatacaatttttgaaaacatctctcttgcaattattggtcgcaagctcccattaagtacaggtaacccttcaggtgtaaaaaaatcttctcgactaactggctgcgcaacgaacatgtcatcattaaaataaacaaaatgttcattcaattcgtcaattcgccacaaattcatttcaattacacttgagttaaacgtaggcagatattgctttggaataaagtcctcatgatcaagcgtgattattcttgaatcttcaattgcccaatttggcgcctgattatcggttattaagtaaacattattcacccatggcgcatacctccacacacgatcaaaccaattttttaacagcccataatccctgtacctagaattatttgcatctattttttgactatcagtcaaatattcatttttctttgcaacccaggttgggtcactcccatccacccatgagacaacaaaatcgattggaaatgccatcgtaaatctccttacttaaatttgcttgattaaaactagtaaacttctgcagtcatcctactttatcagtatagcttccaaccccacttattgaagtagacgaacatgcttgaaatcatatgatatatccccttgatagatttacgattttcacgttgccattcatgatatacaaacgcatttggaaaaaatacagtatttgaaacttcattcactttcattgtgatatcacaatcttccatatataagaagtacttttcgtcaaatccaccaatctttttaaatactgacgttctaaacactaggaatgaacctggtacgttttccgctttatgagtatgtgaatagccatcaggtaagttgatgaaccaggccttgcgtctctcagtacccggtaaactaataaacctaattgccatatctaacacagaagactttcttttcaaaagatgttgtatctcaccattaggaaattttattaacggtgataataaaccaacatctgtattattttctagatattcaatcattttatctaattcgcgctcactactaatcataatatccggattcatcacgatatgataatcactatgcaaataaggtaatactagattgtttcccgaaccaaatccaccattagtttctggcacaatagttttgatccaaccagttgattcaaaagttctcaaatatgtggtcaagctctcattttcaggagaattgttaactagatacaatttaacatccgacaaatcatttgttgacttttctatatttctaactaaattattgactgttttcactgtattgttgtatagcacaattgatatagatactgatggcatacaaagtctccttaaaaattttaattactaaatacaaacgaaatacaaatctaatcctgtattaatatatcatgacggttatcttatatcaatgttgttattacggcagttataaccaattatatatgatttaaatatttgtttgagttcttcatttagcaaaataacaaattaatgttcgatggatttattaccagattgccagcgctagcttaactatcacttgcaaaatctacatacccagtcaatactgtagtgtgagcattgtcataaaggagacgatagtttgagcaaaagaatgaagcagatgggtatattaagcgcactattgacctttgtgtgtcttgccttactaatatccgtcggatacaccgacagaccaaacgtttcagctacagtctatgttaatgctaagaatgctggtttatccgaaaaagtggcatcaaacacaaaaatccttcaaaaaattctagattctaacacaactggtacaacccacataataatccctaagggaacttactatttcgattcaggtgtaataaaaatgcactccaatctcacattaagttttgaaaagggagcaattttcaaatcacgaaacaatgctactgtattctttgcttatcctagcagcaagaaaggatatgatggtggcacttcgaatattctttggaaaaacgccaccctcgtgggtagcgatgaaaacggtcaaggctcattcacacaaagtatgaatcacgcacaagacgtcaaatttcaaaattgtaccttttacgatgccgaaaatccgaatggtcatatatttgatttagatggtagccataatatttcaatcagtaattgttctttctatggatttaatgcaaatgtagcaaacgattacaaagaagcaattcaaattgattattctaatccaggcgcaatgtcttaccaattagatggcgacaaatacgatgatttgccttcatttaatatttatgtatctaataaccaatttcttccaatcaatagtcataatcgaataaagtattacgctcccaatccaattggtcagcatgcaacatatgataacggtaaatccggtataatacacaacatctattttactaataacaaagttgtcgattccaagccacgcaaaacagacactactggcacgattaatttcaatgcggtttctaatttatatattgaaaataatcagttctcaaacattctaacaacgggtgtttcaaattacattcgcatttataaccctctagccacataccatatgaagaatatttggattaataataaccggtttacgaatgtcaacccaaccaaccaatatattttgattcgttcaacaatgcctgaaaatccaattaaagatatttatatttctaacaatattgttaccacacacttaacacatactatttttatcaacagcttaaataacaacgtcactcaaaaaaataataaattcgttaagtagcctgcattcaccaaaagacactgaatttccttgagtctaaagtaaacccttaaactcgaacaactttattaagctactttctggacggtaagttcccggtattttgccggagacttaccgtccagttttgttttgatacgacggtgattgtagaaatctatccattcagtcatagctttgataagtgctgctttggtctcaaactgttcatccataacttcgactttcatgatgtgaaagaacgattctatggcggcgttaccgagacaagtcgctttacgagacatactttgaaatgcacgatggtctttaagcacgatttgccagtgatgatgctggtattgaaatccttggtcagtatgaacggtggtgcgataatctaacaccggtatctgatttaaggcttcttttagaagctttacggcgaattcaacggtggggtgattactaatattgaaagctaaaacttctccgttgaagagatctaaaattggttctaaatagacccgctcgtcttgacttttgtttccgtatcgaaattcactaacatcggcgaccaacttctggtaaggtcgatctgttttgaagcgccgtttaagccgattaggtgcgatcacaccaacggttcctttataagaattatatttcgcttctggcgattaaaagctcgacataaccagtcatgctcccgcatgatacgtaagacccgcttgtgattgattttaaagccgtaatcatgtaaaacatcagttattcgtcggtatccatatttacgagtgtacttcggatcttgttgacgaagctcgtcaatggcctgaataatttgtgaatcgtctaagtcacggccacgatgttccttagcgtactaatacgtgctgcgaagaatatgaaccgctttaagaactagtttgatggaaacttgaaactccggccttaactcgtctactagttcaatgagttcgtgtattttgacttctttcgtgctaaggaatcgagtttttttaagaattcattttcaattttttacatttgattctcttgtttcaactgtttcaattctgcggctggggtcggtgttttcgctcaagtcccgcaatcccagatttcttgaaacgtctttcccattgccaaatagtacttggcgatgataggtcaaagtgtagtgcagtcactggaagcgaagctcgattttgtgtcttccagtttaatacatcgactttaaactgactagaatattcttgagacattgaccgatctttcagacctttaatgcctcgccgctcaaaccgatgaacccaatccagaatgattgaatacgtgctaatgccatacgctctggctaaagctgttgaacctttaccagacaaatattcagtaacgacctttatgcgaaaatctaaattaaatttagtcatagtaaaccccctaagattggatactaaatccaatcttagggggtttacttcaggcccggtgtcttttgtgtatgcaagtcttcattggtaaagtccagtcacattttctcatataaatcaatatacttcgaatactgcgcatttttttcgaaattttttgagttttcaatacacttctcagaagaaaaatgttgcttttctgccagtttcaaagcgtcaataattccttgtgtacttttatcaataatctttacacctgtttcttgagttatcatttcagcactgcccccagtatcaaacgtcaggacaggtaacccacacgcttgtgcttcaatattaacagttggaaaattatcggcaagtgtaggattaatgaaataatctgcttcaccatataattctacaagttcttcacgattttgtgtttgcctaatatgaatgacattttccggaagtctctgtttcatcaaatcaccaaccacaattagttggtaactatcatctattttctcagctagctctcgcacatattttagccctttacgatcctcccaataattcgcaatgaatagcaaaatcttctgatttttagtaatgccatacttttctctgaaagtatccttagaggttggtgaaaacaagctcaaatcaatgccattgttgattactcgacagtcatattttgataagtatgaaatatttatcaagttttttaaccacacggacggcgtgaccaaaaccaagtcttgaatttcaatttgtgtaaaaacagattcttttttaaaataattcttcgatttccgatgccaccataaatttttcgggtactgtgtactatcatattttgattcatactgtggtatctttcctgcatcattcagctgaacaaaccccgaatgagaagatattggccaacaatcatgtagcgtccatactacttttctatgtgttttgtgtaaataatcaaacaaaattttaatgtttaagtagtatccatgaatgctgtgaagattaatcacgtctggattaaacttctcaataaaggcaattaacctttttgttgcatttctagaggcaaaaccatgattgtcaagaatcctagattctattcctgcttcaatcacaccagcttttgaaccaattttatacgtgttatatccatctggagcatcacctcgtccataagcaatacaacattcaaagccacgttcttcagctgtatcatacaactcctgaacaattcttccaacgctaccgaaaccaacaaaggcatcaataaataataatctcatttttcctccaactctgcgtccactagtcaatgatgtagataaatattatctaataaataatcaaactatttagaaaaataattaagcacaaatagttaatatcactgaatattattactaaacatactcaagtattttataatatccatgcaagttaagcaataccacgaatatacaatgattaatctaactgtatagataaaaaggacagaaattattttctgtcctcacgaagccaaaattaatcgtatctacccaattccaaagaatccatgcataaacaacgccgcacaagcagccccaacgaaaggtgcaatcccaggaacaatgatcccatattgccagtcgctgtcagccttgttcttaattggtaagatggcgtgggcaatccgtgggcccatgtcccgtgcaaggttcatggcgaatccggttgggccgcctagtcccatcccaatggcccagactaagagcccaacaccaatcggcacgattcccggcgtcttcacttcagaaatagctaaaatcccagaaataaaaataaatgtatcgaagaattcgacgaagaagttccgtggtaagttccgcacagcgggtgcggttgagaataagttccgaatcgtaattggggaaatctcatcagcagaagcggcaaaatggtccgcgtacatgatccagacgatcacggcaccaacgaccccacccaaaacttctgcaactgaatacgggataaacaatgaccatgaaaggttccctaaaatacattgggctaataccatggccgggttaatacagacattgccgaaaataaaaagggcaattgtaatcccaaaaccccatgttgtaattgcgaagatatggccggaaccgcgatacttggtcccctttaaaacctcactacaatgtacaccgacaccaaaaataatcatcaaggcggttcccatgaattctgccaaaagctgatgaatcactatctttctcctcctgtggcgttgttacgcctgtttattttgaaatagacgccacttactttcagaaagcaccggcacttttttcacacgaacaccattatacacaaaatccgaatcgtttaatatgtaaatcgcaaaaagttttgattttacaggattaaacgttcggattcaattaaaaggttctgattattcttttttagtcgtttttttgcgtttgaagaattgtcgccgaatgcgacgaatcatccgtggagactttggctcaatcttatgctcaaaccattcctgcaccgacgcattgacgacgccaccaaacatcaagagaatcccggaaaagttcaaccagaacatcagtacaattaaactcccaatcgtttggtaagtcgtaatccgtttagcaaataattcgatgtatacccggaatccttgcgagatcacgatccagccaatcgtcgtgactaacgcccccgtccaaatgtaacgcaatttcaccttggcgttcggtacaaagtaatacaacaacatggcgacgacgaacatcccaacaaaggtaatcaagtttttgttttccaacaactgattaatccaattcggaatgattgcacgcgtgaggttcgttaaattcaagatcacatctagaatcaactgactcaacgtgaagaaaatcgccagccctacgattaggagtaatagtcccaacgttaagaaaaaggcaataattcgcgtccaaacggcattttgggcatccgtaaccccgtacgcctcatttagactcctgcgaatcgcagcaataattttagacgccgaccagactgtcaccaaaatcccaattgacaaactactactgctgccactagacaggaatgaaactaaaatcggcttaaacgtctggtaaacattactaggaatgacttcctgagcgtacgctaaaatctgcccagacttcaaatcgaaccgggcaatgaggtttccggcaatcaagataatcggggcaatcgacattaacgcgtagtaagctagcacaatcgcattattgctgacattggcttgtccataccgccgaataataatttccaggcttttcgcaattttagggtaacgggcttttaaattcattcatttatcctcaacgctcacttatagtatttacaattatacaatggaatgccgcgggaaacaccttttatactaggattagtgctttcagcgaatagactagtcggtccaatcagatcaattgatggcaatacctgaccactgacgagtaaaatccgcttatctcccagccgtcagccactttgacaaaatcaagtagctgcttagacgctcagtggtactgggcccatccaaattttaacacaaaaaaataaccggtattgatacccccgcggcatccatctccggctacttcactaatttcacatctttacaggagaagtgaaaatttttatcactatgtcagtgcttaatattacactgtttatacaaaaatgtaaataattttaatgtgtaccaatttttttcataatcgcttgtaagatgtattccgcagcatgaccatcgccataaggatttttagcgtctgccatccgttggtacgctgcggaatcatctaacaggctggtcattgctgccgcaacctgctgaccatcagtgccgactaatcgtaacgtccccgcggtgaccccttccggtcgttcagtagtatcacgcaatacgagcaccggtttattcagtgacggggcttcttcctgcaccccacccgaatccgtcataatgaagtaactgcgcgccgccatgttgtggaaatcaagcacgtcgagcgggtcaatgaggtgaatgcgatcggtatggccgaggatacgtttagcgactgtctgcactgccggactcaagtgtactgggtagaccacttcgacatcgggatgctgagcaaccactcgtttgatggcgacaaagaccgcttccatcggggcgccctgattctcacgccgatgcatcgtgagtaagatcatccggtgcccaggctgaatcaaatcaagcgcagcgtgttgatagtccatcgaaaccgtctgttttagggcatcgatggccgtattgcccgttaccgtgatggccgtatccggatggttttccttcaatagattctgccgacttaattcggtcggtgcaaagtacatgtcggccagcacgtcggtcagctgccgattcatctcttcaggatatggcgagtacttctgccatgtccgcaaccccgcttccacgtgtccgactgggatttgatgatagaaagcactcacactagctgcaaacgtcgtggttgtatcgccatgcaccagcacgatatcaggcttgactgtatccataattgcatctagcttcgtcagtacccggctggtgataccagctaacgtctgattaggcttcatgatattcaaatcatagtccggcgtaatgtgaaaaatcgtgagcacctggtctaacatctcgcggtgttgagccgtcaccaccgttaccggttcaaattgtggctgttgctgcaactgcaacacgatgggcgccatcttaattgcttctggccgcgtgccgaaaatcgtcattaccttaattggttttgtcattaactttcacctgcatcatttagtttctaatctcatcatagcgttagttacgtcgtggcgccatcatttcgagtaaaagtttagttattttcaaggattcagccaaacggacgggtaagcaaaaacaccaccttgattgcaggcacacgttctcccgcaattaagatgatgttcagcccgtaccgtttctaaaaaggtaccgtcttcaataaaatatcacgaatcttatacgcgacctggttgtcaccaccaaaaacaccctgattttcaaataagactaaggcgactttggcatttcgcgaccccatatagtagctatgaaaattattgtcattgccacccactcgaatcaactggcctgcctggtaataaacgcctgccgaatatttaatttgaaaattatccgcaagtgactttaaaccggcttcaccaactagctggccgctttgaagcccatacataaatttataataatcccccacactcatatatagactaccacagcctaattcactagattgtaacggcttagaaatgatgccactctgaccaaacccattagccaagcgatacgaagtcgggttgatcacattgcccggaatatcgttatattcataggtatgttttaatcccaatggccgaatgatgtcattagtcaaagccgcctgataggatttatgcgtcactttgcgaataacccctgccaataaggtaaagttcgcgttggaataggcataagcatgattattcgtcgaccgtaaatgttgcagtgtaaagttcagccgcgccgtctccgttggtaaaatcgtctttggtgttatctcagtcatccgaataccggaacgatggtctaatagttcacgtatcgtaatctgattggcgtacggaatttccgggtaaaagtgactcagcttcgtcgtcagactcaacttaccctgattgatcagtttttgaatcatcacgccagtcacagctttttgtaatgacgctaatggataagcctccgtcgcagtattgcggacttgattggcatcatccgcataaccatacgttcgaacccggacccccgccggaccgttcgtggtcagtaatagtgtccccataatatgatgacttttgatcaactgatcgatttgcttgattgcctgggcctcagtaagctggccgggcttcactttaggcttagtcgtcgtttgctttttcgtcgcggatttgatttttgacgctgcctgctgtactttaattgtctttggtgtcacttgctgtgctccttgacctaattgctgtgatccccacacacccacgccaatcaaccccagtaagattggcaataaacttaataaccaacgccgtttgttcatcatgatcccccctgttcctgatgagtcgcccgtcaaatctgacttgactactatttaattgccccaagcatacgccctcacttctgactttgcattaaaatgcgaattattgttagtccgccgaaccaaatcgcaagcgctatcaacagcacggttttaccacaatcactaaaaattcatcaaaatttagttaatttaactcgtgcaatttccgaacgtgaccattaaaatgaagattatagttaacttattcaaggaaggatgatcatattgagtcaagcaaccgattatgtccaacatgtttaccaagtcattgaacaccgtgatccgaaccaaaccgaatttttagaggccatcaacgacgtcttcaaaacgatcacgccagtcctcgaacaacatccagaatatatcgaagccaatattttggaacgtttgaccgaaccagaacggattattcaattccgggttccttggctcgacgatgctggtcatgcacgagtcaaccgtgggttccgagtacaatttaactcagcaatcggtccttacaagggcggcttacggttacacccatccgttaatctgagtatcgtcaaattcttgggctttgaacagatcttcaaaaatgccctgaccggcctgccaatcggcggtggtaaagggggctctgatttcgaccctaagggcaaatcagacaacgaaattatgcgcttctgtcagagtttcatgaccgaactgagcaagtacattggtctcgataccgacgttcctgctggtgatatcggtgttggtggccgcgaaatcggctttttatacggccaatacaagcgactccgtggcgctgaccgcggcgtactcaccggtaaaggtttgaactatggcggttcgttagcccggactgaagctaccggttatgggctcgcctactataccaacgaaatgctcaaggccaaccaactttccttccctggtcaacgcgttgccatttctggtgctggtaatgtcgccatctacgcgattcaaaaggttgaagaactcggtggcaaggtgattacttgctccgactcaaacggttacgttattgacgaaaacggtatcgacttcaagatcgttaagcagatcaaggaagttgaacgcggtcgtatcaaagactatgccgaccgtgtagccagtgccagctattacgaaggttccgtctgggacgcccaagtagcttatgatatcgcgttaccttgcgccacccaaaacgaaatcagcggtgatcaagccaagaacttgattgccaatggtgccaaggtcgttgccgaaggggctaacatgcctagcagtccagaagccattgcgacataccaagctgccagcttgctatatggtccggccaaagctgccaatgctggtggcgttgccgtttccgcccttgaaatgagccaaaatagtatgcgtttgagctggacttttgaagaagtcgataatcgcctcaagcaaatcatgcaagatatctttgcacactccgttgccgctgccgacgaataccacgttagcggtgattacctgagtggtgctaacattgctggcttcacaaaagttgctgacgccatgttagcgcaaggcttagtttaagccaactacatttaatcgcatcaaaaaaacggattgtcattatcgacagtccgtttttcattattattaatcataaaatcaagttaaaccttatcagccggataacccgtgtgcgcaaccagttgcgcgtaggtttcatgtaacgtcacggccgcgacccgccagccgaccttcaaaagcggaatcaaccgcagtgggtcttctaccggcacttgatgttcatgggcgaacttacaaatcgccggtaaaacttccatatcagaattagcaaaataataattaccgctatcagtcagcacaaagatcgtcgcccgaaatgcgtggcgtgggtcgagtccttccgttacgtgacaccgaatcgcaccgatctgaattcgccgcaccgcactcagtggcatttcacccagattgcgtccttctggtgaccacaaaacgacctttgtcggggtcagttcgaccattgcgtacttctcgctcgacgtccccgataagcgccgtaaccagttacgttctggttttggctttggatactcctgtccctgaatctcaaaatgaaatggaaccacgcacttttgcgcccgctcaatggcccgataatgacccgcaatttgatggttcgtaaaaacagatgccattggtttaaacataacactcacccctctcaccgtcagtatacgctttcatgtgacaatttacagtgatttcatcacgacagttttcattttttgtcgcagtgttcggctgaaaataagataaaaatagcggccaaattacagcgtaacttggccaccacgatacttaccagcttggctcaaactatgtgtcaatattcactgcccctatgtgtgctaaccgacttgcggtcacccccgctttgaaccattccgataagcctggatcaaagtaataattgctgaagtcaccaatcagaccttctgacctcgtcattgcaaccgcagttgcctagtcaactctgaccatcattattatagcacctttgttaacggttacacaacgctagaactcattccttaagtcatcaaaaaaagcttgccagtttgacaagctcttggattacgcttattcagcatcattgggctggctatcatcaaagtcagctggcatgatggcaaagttgctagcttcagttgacaataatgctgcataggcccggactttggcagacaacgctggaatgatggcaccattcaaattgttcaacatttcttgttcgtcgtcttcaattgatttgttgtcagattgacgttcaataattcccaccatctcaccacttaggcgtacaatcgcaaaaacggtcgcggataagtcgaacatttcttctttataggtcacttgtaattgagcctgcacaacgtcatcgccaaacgtcttcttaacatctggattggcggtcgtatagctgaattgcccctgaccaggattgtcatcgtcttcagaacgatcataaacgatttggaaatgtaagtcttggattgctgagtttaagatttcaatattcatttagccaaactcccttttatatattactcccaccataaaggaaaacttggcaaaatacaatcaaatttgccggctttttgtgaataatccgttaatatgccgttaacgttttgtaaagtcagtaacggaccttaggttgacgctgactcgaattacttatacactaaataaggattttagttaaggggggcgttctatcatgtcgatccaccgaggattaccagtgctcgtcatcctggccgtctgtggcggtttactgaccctgccggcaaccaatgcacaagccttgcgagttcggggaacccgtgtcacaatgcgagtcaagcaccgggcgaagccgtcgaagcaccactactcgaaacggtcagcccgctcacacaacgccaggcatcatcattaatttattgcaaatctaactaaaaaacgattagcgtcccggttacgagacgctaatcgtttttgtcgttctattcactgcatgtataactttcttaaccagatcgctcaccagtgttgtcttaacagcagtatcactgccacacaacgtaactaattttgtacccgttgtgcgtttttttgacgaaccttgtcaggcatcgtttcagccagtaagtactgtcgaatcaggctgacgatttgcttattctgtggtagatcggagtgcgccgtattcgcccccgttacagtaatctccgtaaaatgcttgacctgatcttgaaagatgtacttaccgtagttaacgctgttatacggcaccgtcccatcactggtatagttttccgtccccgcaatcgagtaaacggttaacgattccggcaaaccagtccgataacggtaaagttccttgaacatgctcgtcttggcggtcgtacttgtcgattccatattgtacggcgaggcaatcgtcattaaccggtcaatatgaaccttcggactttcctttagatagcgctctaaaaagagggtccaaatgaggccaccattggaatgacctagcgcataaaagtgattaaagtgatacgttttgaccaacgccttgaatgccgtattcaaccagacagcttgcttatcaatattagctttaccatcacgattattcgcgaagccaatcacgatgaacggctcattatcattagcagcaatcgaaccactatacttaattgtcccatccgtctgaactgtcagcttcaatacactgtgttttttcggcgtttccttccccaactcggtaatcaaactatcaaaccggttctgtgacgcactcgatccggggaccataataactggtgccatccgcgtccgaccagtgtttttcagcgtcttgatattcgcttgactccacgtgtaggccggccaacagatcccgactaacaaaccgattccaagaagccaccgccaccaatatcgtttaagcatccgcctgcgcctcctcctcaacctggtttgccaataggacaaatggcaagtagattgctgtggctaccgctatattgatcagactaacgatgaaggcccgccagtcgccaccagttcccagccaaccggtcaagaagcccggcatcgttctaccaaccggataaacgaccggcggcatccattgaagcttcaacgcgcaccacgtgatgaccatgctagccagtggcgctaatagaaacggaatcgctaaaatcggactataagcaatcggtaagccgacgagcaacggttggttgatattaaacagtactggcaaggcactggtcttggccaccgttcgataattacggttacgtgaacgccacaaaattgcaatcaataacgctaacgtcattccgggaccacctacgttcgcaaacgcatcaaataacgtatggagcgttactggatttggcgcgccccacgccgaaccgtgttgcaacgcatattccaaattttgaaccgtactcgtagtactgttaccactaaagtcaaccggaccgataatcccaattaaccagtataaattgctgagtgatgccacgccaattatcgctagtagcgacgcccccggattactgaatggtaaggtgaagaccgcgtaaaacaggccgtttaatccccctttactgacaaaactaacaccatacccgatggcactgaacaccagcaaagcagcgactatcggtaaccagttcgcgtgtgcccgcgctagcaagtgggtctgggtctcgatctcctggtggatgtgtggataccgtgtcaaatgactgaacaaccaaccagtcaacaggcccaccaatagtgcgaggaagatgccctgagttcccaaattatcttctaaaaaccgactgccagcaggctgaccctgggtactaaaaaaattataattgatattaagcatgataaaactaattgccgccgtcaatcccgctaacagattgtcacgctgggcactccgcgcaacaaaattagcagctgaaaaagccgcaatcacggcaaggatgccgttgatactcagattaagcatcgtcgtgtaagttgccaaatgtttaaaccccggcagccagtgactgagataataaatatgattcaaaaaaccattgcgctgaaagattgcctggttcataaaactaacgtacgccccaactaatgcgaatggaaaaagcagcgtcaacgtatcacgtaaggcgcgccaataacgttgccgctcaacgacccgttcaaaggtcaataggctgttctgtacatgctttaacatacctaacccccaaaagaaatttactgtctataatatacgctagttcatcgaccttgcccactaggtgcgtttaattttattgcccaacactaatccattataattatcgtaaagataactggaggtggttataatgccaagccgttacacaaatattttagtacccgttgacagttccgatgctgcacaagccgcttttactgaagcggtcaacattgcccagcggcaccaagcaaacctgactgcgctctacgtggtggatgacagcgcctaccacacccccgcactcgacccggttctatctgaattactagacgcggaagccgctcacgcaaaggatgccatgcggcagcgacaacaattcgtcgccaccacgtccgcaccgaatttaaaaactgaaatcagctacgggattccaaaacacaccattgaggactatgccaagcaacatcccgaaattgacttgatcgtgctcggcgccactggtaccaactcgccccatcgcgtagccgttggttcaacgaccagctacgtcgtggatcacgccccttgcaacgtcatcgtcattcgttaatcgcaacgcccgctactagtcatttggactggtagcgggcgtttagactaatacagtattcatttcgatttcatatcatttgtggctacttaaacccaaagcaccgttccaaggtaacgtcactaaaacgctgccctgaaacggtgctttctaatattcaactgaccttacccggagtagtatatggtggctagacactgacatagcaacgtttcgtttcaaaacgtgcaccaaatgtgcaccaaaattcctaggcgggtaatacataaaaaatcccccacgccgaaacgcaagggattagcaaattcaatatttaattatactacttttagcttgcttgtgaggcggattctgaagtcgtttcgttaactgattgcgcattactatctaaattagccgctaacgatgacgctaaagtggctgctgaactagccgtgaccgtgtcaccaactgccgccgcactagctgcttgactgtaagccgccactactgcctgtgatgcttgggcttcggcttgactagccgctgctgagttagctgcttcaatcttagcttgagcttctgccaaggcttccacgaccgtttgctccgtagaagctaacgtgctcgacttggtcttgatcgtattgccggtatcttccaaaatagaattatccgtaattgccccgacaaaagctaggattgcccccacggcggtaatcactagcacaactgcattagcgtcaatcttaacaccaaagaagaccgttgcgacagctaagccaataatcaacacggacccgataatctgggcccaataagcgggctttttgtagttagctttgagtgttgcctgaattacatttaaaaattttgtcattattttccctcctaaaggaacttttctgcgatataaataactaacgtgacaagcacgccactaaccaagacaccgatcagccaattttgaatggttgtcacgcggtcaatttgatggctagcttcgatggacttggctagggccttgtccgctttgtcgccaatatcgtcaacttgattcaatttttcttcgatgttctcaactttcgttttggtggcggccacatccttttgaatatccattaataacttagttgtatcgtcgtattgtgccattaccgcaccaccaatcgctggccaggatagatagtggcgtaaatcgtcttgccgttctgactagccaatgtagtcatgcttagaccgttacgctgtgcgattgtccaccagctgtcaccatacttgactgtgtaataagtgtggctaaccggctgacccgtaactcgcttaccgtaggctttcccattggtaacgcctagcttgataaagccatacaggccgtttgagcgagtatagcgtgcccatacgtagtcgtgttcaataatgaccgcgttgtaagtcacactctcacccctgtaataggtagccacttgacgtaccttgtcactatccgtgtagcgaacagctagtgtccggttaggatagaacacccctcgctggttgtatttgacaaccttaaaggtggctttcttagctgcctgagccttttgagcctgcttaacgttgatttgagcttgtttcttgctagcagtcgtgtatcctgacttagtaattcccgttaggtcaacattgccgtctaatccgcctgccttatacatgctagtgaattggaagatagccacaccgtccattgatgggaaccagttataatccggcttagttctaaccaagtagtctggatactcagctagccatagacagctaccataggcacgtacaatggcactagtattaacatgagcattgaggtaggccttaccggaatacaacataggtgtatagccagcgtccttaatcagcttcatctgagctagaatgaccttagtgttggctgtaacactattagaagcgccatcctcatagtctagtgcgacaatactacccttgggcgtcctaatccgtggcaagtaataggccatcatagccttggcgttggtcatattgccaccaacaccgtcccataaataggtgtgtacccgcttaccagccttcttagctgccttaacttggctgttatacgtggtctgagggatattagtcccaccatagaagccacccgcctgtgagaatacaaacttatcagtgttgtagccgaatgttccactattaccgttatacttagaccagtcgaccccttggtcacggctagttgacgcctgactgtttaaattgaccattaaaaaggccataaaaatggcgcccaccgttaagatgagtgcctttaacttgtgcttattcaattgtctacccccttattcaagactactattaacttggaactgtaacgttgactcactagggtaaattgacgtcccggtactatcaaccacccatacttctagctgatagtctcccgctgttaagcttgtcattaaacccgctgttaaagctagcacaatctgaccagtcgttgggtctgttaacttagctgggtcaactgtggccgatttaagatagccactagcattgcccaatttaacagtaattgaagtggcattagttaaatcagtggctacattatcattgccacatactagtgtgaagctagtggtggtatcgccaattttaacagtctgtggtgaagtatcagtaaaactaagcgttttcgccatctttaggcgcctccttttcagccaacttggcattaagctggtcaatttgaacttgtgccatcgctaattgctggtctttaagggcaatcgcttgggcatagttactagtcagcttgttaatcaaagcctgtgcatcaatattcatatattaagcctcctgtgtggtggttgtcgtagttgtggtaactggctttaaagcagtcagactatcaatcagcgtgttcaacaccttcaatttaaccctatctgctcccccagcacctccagcaatggcagcgttaaattcatccatggtaatgcttacctgtgaactgatccccagcgtgttaatttgaatgctaatagtcataatattgttcgtgtaatctggtttataatttgtaatcaaaatgctatcaatttaattttgcctccaatttgtttaatctagcttccaattccatgttgtgaccgtttaattggtcaatttctttctgctgttcctgtaccgtggctagggtagcgttcagtagcacactgtcatctaccccacatagcttgccgtcttcatcacggctgataaagacgtctggcaattgccactgctttgttacattaacgtcgtcaacaatggaagacagccgcaaatgactggtattatcgtcggttttgtactgataagtggctaagtcaatggagttaactagctgcgcccaataagctgtgtcaaccttttgaacatcctgcttaacactcaatagagacgatttaactaagctagtatagttaacagcaccggcatagatatcggcggtaccgcccccacctttagcaaagtgaatagcgcccttatcagcactggtaaacgtatgaccggtattaatttgtaagttgccaatatccagttcgcgatgcaagaaaatattgttagcaccggcagtgtcaataccgaagtcagcaatatcattgctattaatatctctaattcgccaataagaagaattcgcttgtgcatatatattgccataagcatccatagtaatcccgttactgccaatattatcggcattaccagcaaagtttattttttgcgttggcccgtatagatagattcctgaggctggtgttacgttaacatagcctgtgattgtctccggattggaaaaagttgtatctttggctgacgtataacctgattgtgactcaaagccttgaccgttaattactgaatcataagctaagtattgcccactaccgatcattgagcgatatttatagctaatcgccccagattcaacgcttgattgcagtccaaccgcactgtcaaagtacgtcgacttatacgccccgtctggcgtaatagtcattggataatatttagcggtgttattggcattgctaatgatgtcgcccccatggaacgttttaccgtttaatgtatcagtaatattcgcgttaggaattataactggcttcttagtatcaaaaaaaacagtgtcagcagatagtgttaactggccacttgaagaaatcagcgtattgccagcttgcacattaatctcatcaattaactcatctttcgacactttgattaagacatcatcagacgtttgcgcgatcattgaatcttgaccaccgtatacgtaaggtgtagccgtatcaccgagttctagttttaattcggtaaagtataacccagaagaagcactattattagacccaatgttgtcaactcgaatataaccttcgttatcattagcaccagtcgtaaaagtaaccgtatactggtcaatctgtgatggcgaagtcactaagtttttaaagagcccatgaacggtgtcataatcactggtggaaccataagccctagatagtaaataaacgtttgcaccgacaacgttagaagacgcaaaagctttaaattgaaacgtgtaggttgtatttggcaataatgggaaccgatttgaaccagcggcagcagtaccattttgagctgtatttaaataaagcagtgccccggtgccgttctggtagaaagtatgtgtagtcactaatagtttccggtcagttgccccccagttcattaatgtccaaccagtaagtggggtagtaaagtggcttgaatatggaattaagttggcattattagcatcggatttagaaaccttgctagcaatcatatcagcggtttgtgtttgataagttttgaagtcactagactcaaccttgctagatatttccttagcagttgtagcttggtaggctgagaagtcactagtagccaccttttgggctatcaagtcagcggtagttgtttgataagctgagaaagcaccattatcaactttgctagcaatttgactagccgtctgcgtttgataggttgagaaagcactattacttactctatccgctatctcactagcagtctgtgttttatcagacgcatactctgagctagaaactttgtcatcaatcaggtcagcagtctgtgtcttgtacgtgttaaagtcgttagacgacaccttactatcaatcgacttagcagttgtagcttggtaggctgaaaagtccttagtagccaccttttgggctattaagtcagcggtagtcgtttgataggctgagaaagcaccattatcaactttctgcgctatctggctagctgtctgaaccttgtaactagcatagtctgagttagcaaccttggtagctagtccattttctaggtcagcaatcgttagcttggaaccgtcttttaggtctgtcactgcttgactagttactttaccattatctattgctgtagtcgcttggctaaacgcattatcagctgtactttgagccttagcagtagctgtagagttgttgcttatctcagcactagcttgactaccaactgcttgagcttggctaaacgcattatcagccgtactttgagctttagcagtagcattagactggacggctatttctgaattggcgtagttgtaattgctatctgcggctgatttagcggcattcgctgtagactgtgcaattaaagcagcgctatcagcatttcctgcttggctagccgcattatcagccgtattttgcgcgttgataatctttatgccatcatcagttaagatgacttgagttgcattagattcagccatctaattcacctcccttctaatcggccgtgctatcattttcattgattgtccctttatcaatcacactagctaccggccgtttggtgatgggaatcgtgtacactttttccttttcagctgaataggggtcaatttctagtacccgggtgttgaaggtcactaacaagtaagcctgcgtgccctggtaaaagacgttacaagtttccacttcacggctttcatcggttaggttgggtaagaccatatcattgtcaaagtaagcttcaaactcggcccctttatggacaacatttaacgcccacactttatgggggtcgttagtagtctcagcttcaccaccaccggccgcaaagtagaagtaagggaagtctagacattccgattggtaagtgttctggttaaaatcaatcccataatcggtgatattaaagttgtatagcacgttataatcaccagctaacaggtcactagctttgagaatgtcagtagagccatcagaatagccaattgagactaggtcatgttggcggtcatagttaacgcggccgtaacctttgagtgccataacctgttgcacgcgactatcagtaggctgtaacgttaccccggctacataaggaaaccgcacgagcatgtacttaccatcgttctttaagctgacaatcgaccaaatatagaccgtgttattaacctcctgcacgccgaacgtcccaccatgttgaccatgaatttgtaacatcactgactgcacggcaaacttgctatcctgtaaagcaaacatggtatcactagacccactgtcatcacgagcccgactagttaggtactgcccattgcttaaacgtgccatatattgagtcgctgaatgcgccccattatcatcagggccatagacgcctaaatagctgatattagtggtgtctaacttaatctcggggtcatcttggatatagtcggcttcaatcgtgccatgcaaagtgccgacagcgttactagccgcgttaattaagtagccggtttgttggtagctggtgtcaaccgtgccatcggtattataacggcgccaaatgaagcccttgctatcaatgtaggatgaaatattagtgctaccttcccacgcctgtaaaatcaaccgtttagtctgggtggtatccgtgaaattgttaccgtcaggcgttaaagcaaccggtttaattgaactagcgtccttcttagcttcatcaaccgccttactgagtgcattctggtattgttccatccatgctggggtggctacttgaacagttgtatactcgccaaagccgactgtgttgccatacgggttagcaaagctaattgtccgttgaataacacgtccactagcgtctaataccggctcaattagttcatctttaaacctaattgtggcacctaatggcggattaaagttgggtgttacattcacctcataatacgttctagggtggttgtatagcttaagcatatcctgagcccaggctttcaaaccggctgaattgctaatctgattagcggtaaccacagcttcgtagtacaggccagcttgccaatcggggttatatttctggttagcggcatcatcaacgatataaggcttgccatcattaaccgaagcgattgtgctaccgttagcgccgtatggaattagcttagtgacaggtgttgaaacggttgtccgtttaatgctggtcatgtttttaccaaatactgcttcgttataaaccacatcattgttcagctggtcagtaatgacacacacctttttcgtgatgttcccttgtgagtcaatctcaacatatgggtcaatctcacaatcatacgtttgaatgagtgtctgtactaacgtgctagctttagtcttgccgtcaatggtgattgatggaatggtcgtgttagtggtttgatagtctagtgtccaaccagtcgcattaaaacactcgttaaaggctgtctgaatcgaactagcactagccgtagtggctactgggtaatgatgagctaaactgtacaagcataggttggtaaagttagccgttgtaacatgcttaacagcagcggtattgttctcttccacgctgtatatgcgcatgacgtaccaatgacccgatagctcgtcataataggcgagattgttaccagccaccactttatctgaatcaggttgatcttgaagcacgtctagttggccttgatggtcgaactttttagattgggcatttaggttaactgtcccatttaaagcgtcatcggttcccacattaaggtcatcatcatagctggtgctagttgtgtctgagtcggctagttgaatcttgatgctgtcattagaaaacttagtggccccatcaacggtcagggtaccaatccgttttaaattagggtctagaattaaatactgattatttaaagccatctgttaacctccttgttttaagttatgtaaaaaggccgcccaattgggaagcctttcagtgttgttatagtaatctgggtagatatttaagtgttatttgggcgtcatctaagtcaccaatcatcgtcaggctattaactcccggacttaatttaggatagtccgttgaccaaatggggctagctagcttaccgccaaccgtggtgctatcagtctcacaatttaagacgatctcttgaccagcactagcaatatacttaggtgcgtcctgtgccacgtcattaacttggtagatgtttaggtgagtgattgatagataagggttctcatagcccacattttcgtcatcttcagcaattgagtgcttaaagaacaccccaccgataccacctaaggctgactgataatttgaattagtgtcaacgaacgtcccgtgcacgatcagaaaccgtttagggtcggtacaaggctggccggaatggctaccactggtgtagtattgcgtgattgaccaactaaacaccttgccatttttaattaaatcgagttctaaccaactggtacttagtgccgacttttcttctttgttaacgaccgtgatatacttatcaaccttctccttaatggtcttagtggtaactttgccagtcttcttgtttttagacttcttaaccaccgtcttagtcgttgtcccagtcttaattttaatcttctggtctttaccgttgctagaactacctgaggggcccttgccattgtagaaagtctcatgtttaccgtcaccaccggcaaaagtaccacccggcttggtgatttgtagataacaagttggggtaccacctgaactagaatcagctagaccaaaccgacctatcgtagccccattcgggtctaataacaggacttctacacgccccatcgcacgcccattatgggtacctgagtgcttgatatggtggattctagtcttaactcgatagttagtcaggctgttagtcataccggtaaagcgaacaccgggaccataccagtctggttgatggctaccatactgtttaaccccattggctagcttgaccattaacacttgggtatctcggttactatcagcttcaccttgataaatgtacttgccagcggtcttcatctgagcaatcgcattggcatcattagtccattcagccatcgtatttaatacgtcactgttcacaacctgcgtataaggctgtaccgctactgcttggtcttcatcactatccggtcctagcccatattcaccaccatttagggtaaagccaatgtgctttaaatcccgcttaggcacgacttgaataactggttctgttctagcggtaccatcaacagtgattgtatttaaaccgttctttaatggtgtttcaacctgtgggagggttgcccgtgggtccgactgcacaaaggtaatcgttaaagtcatgtcatacatacctgtgttaatcggggctgggtcactaatcgcggtaatatgcccccaatagctcaccttgggttcaaaaccaaagattaattgatactccttgttattatcactagggtcatcgcttagtagcagaccacttaggttgtgcattatctgattaaatctagcttggttatcagcacagtaaatggataccggtatactaatcgttcggctggtaaaatcggtgccattaaattggttaccatacatggccggtatatcagtcacctgttcagccatggccggtgcactaggtaataccacgtttcccatttcgacctgtaaatcgtcccggctatttaagccagcatattcaaaatcatctcgttgtaaggtcacaatttaacctcctttttaagtttagctatgtaaaaagggcgcccatttaaggacgaccctttgattgattgggatactagtaccccatcatttgtgaatactgtgaagtcttcttagtgtaattcttgtttgcgttaactatggaatcgttagaaataacggcttgtacgtttccttgaccagctaataaagccaccaatagtgagatgactttatcaagcttctcattactttcactgttagtagacgcaacctgcgtgctagtagtgccatttacaacctgactagcctgtgcgattaactggttagcccgactcttattagtcaatggaagcaccatttcaggcttgttatgttcagcgacctcaatcaactggttagtgttgataatcccaccgttttcaaaccgcttatgaccttgtggcccactgtgcaaccagtcatatttagctgtaccccaaatagacgtattaccagtggcagttaaatagtcgctgttgtttaagaacgctaggacttggtcaaagctagacttccaatttttatgacccggaaaggcaaacgcatcaaaggtacctttagtgtattgcaacggcccaaatgcaccattaccactagctgagttactgtctgagatagtctgaccaatgttacggttacccgtttcactgtcggctgtcttaatgatagctgactgcatcttagaccaatactctttgggcactttagtcatttgaagggcttcattaatcattgaatgagtaatagctccaccttcaattgaaccactgccggaatcgccaaactcgttagccagcttgttgataaatgaccaaaagccactaccaacttgcttcttaatcgtgcctaacaggccactagacttagatgacttatccgagctggtgctatctgataatccgggtactcgtccataaccagcaaacgttccgtatccaccgccgtgaactctagatatgcccataccagacttctcattttcagctgaatagaactcgccattgccggtataaaccccaacgtgttctgaaccaccggggccaaagaagactaggtcacccggtttaggattgctgacatgcttagacgccttatactgctcaccactagtacgcggaaaactaattccaagcttttttagggtgtactcaactaggccggaacagtcgaacgcactaggaccagcagcaccccaaacgtacttgttggtggcaccgtatttctccatggcattaactagactagagctagatgagccactacctagactatcactaacgtcaccccataaggttgaccaccacgtcttagcttgcttttcaacaccattgaataggccgtgaccaatgttactaatcacgcctgagacgcccttagaagaccagctaaacaggttctctaacgacttaacagggtgagcaataatgttagtggcggtattaaagaacttctctaaactgccgaccttcttaccaacccaactagtcacgcctgagataccactagtgacgctgtttagtatgtcaccaaatatcccagtacctttagcatacttagtcacgccttgcatactcattaacatggctgtctcactagcatttaatacctcagtgccagctggtaacatcatcttagtgttacgtccttgaacaatacctgagtcaccattaggtagcatgaccatttctttattgccagtttgcggactgtcgttaccatcgtttaacattgccatagtaggacgtgtaatcgggttacgtgacccactaaacataccggtaccagtggcaaaatgaacatgacttaaatcaccaatggtcttctttttaccaccgaacgtatgaataacactatcaaccgcattgatcccaccgttgataatatcgatgacatcgttcataccatctttagcaaagctctttaagtctttccataaacctttaaagatattctcaacgccggttcctaagccagaccagcctgatttaaagctctttttaaaggctcctaaccagtcactcattgaatggccgaacactttagtgtggcttaagtccttgttccagtagctgtgcagattagaccgcatagtgtcccagtggttattccaactgtgtgaccagctctttttccaaccggcccacttagtgcccatgctactaaagaagtccttagtgtgcttatacgagctattccacgcgctatgcaagttgctagtcatggtatcccagtggctattccaactctttttaaaggctgacttccagctatcccactttttaccaacagtgctaaagaagttcttggtattcttaacggaaccattccagtcagcctgcatggtcttacccatgtctgaccagtgcttgttccatgactttttaaagctagatttaaagctatcaaagctgtctgaaacggtcttaaaccacttgccaaacttagtcttgctaaacgccttagaagcgtcattgacctgtttgtccatcgccttcttaaagcccattttttgaatgtctttgctaaaacctttagaccacttttgaatattcttaccagttttagtgtcctttaagaaccatgtagctaggcctgcaaatgggttaatcaaagtagttagaatttcagtcctgtgtttcttaaagaagctgccagcatttttgccccatttatccatggttttgccgactttacctagttttgatccaactttcttttcccagccatacttgccactaaatagctttttcatcgagttgcctaggccattaacccactttctaaatggcttaatgtacttataagcggctactagaccagctgtcaaagcgcccaaggcaacaactacaataccaatcgggttagcatccatggcagtgttgagtaaccattgagcggccgtttcttcaccactagctttagcggctagcctttgagccgtgcttagcgacctcataaagccaattgctttaccaataccactagcaatccctaggaaggccttaccaatacctgctagtttagaaatggcaaaataggttacaatgcctttacctatggtttcaatggcacctttatgcttggcaatattagctgtagctgaggctacaccgttcatgccttttgaggcgtccttagaatgtccaccaatcagttttaaggcaccagctacagctgaccatgcacctttagctagactgccaacaatactagcgattgcaccgccagtcttttcgattggcttttcattcttaactagaaagctgataacatcgccgacatactggccagtcttcttaccaagtatgccaactagacctgttagggacttcttaacatcatctaaagcgcccttctttttagacaccccatcaatagccttttcaacaccagctactaaaggcttagcaaaggctacctttaaattggtgtaagtaccttggatagcggccatcttacctttagtggtctcaccgaactctgaccatgctttgccacttgtcttagcggctttgaccatatagccttgtaattgtgagccagtaattttgccagccgctagttgcttattaaaggcactagttgacataccactagctttgatgatggccttttgtaactcgggtacttgactaaatgatcgtttgaataggctggctgttactttagaactaccagctagtttagcaaccccttgagttagcccggctatctggtcgcctgatttaccagcagctgaaccatagctagttaacacttcggtcatggcccgggctttagtggtgctgttagtcatggcatagaatttcttctgcatttggtcaatagcgccaccggacatgttggccttagagcgaatatcactaatctgagctgtcatcttagttgcttcactgtcagacaggcctaaattagtccattgtttttttatcgtgcccccagcttcagctagttcgtaaccttgcttggtgacatccttaatgtaaccaactgcactagacgcggcctgactaatagtattgccaatgacatacccaagggcaaaatgcttggtttcgccattagttttcttttcttcatcacggactaagcctagtttagacttagctgagtcaagcattctggtaaaggccgttggtttagccttattcatggctgaatctagctcattagtctcacttttcagcttagccatactagtagcggtctcattaacccgcacttgttgccgtttataggcgtctgaggtagccccactagccgtcttaattcggtctagttcgttagtttgggccttatattgagcctccatgttagaataggcctgctttaaaccgcctaagcgggccttattagcttcggcagacttaccttcggcttctaagcgtttcacataggactcacttaaagccgtactttgtttatagcccttttgcaggtctgctaaacctgagttgtaatactgtagctttgacttggctcggtctagttgaccacccatactgtcatatgatcgactagccttgttgatctgatcagatagctttaaatattgctcttcaccatctttagtgtctctgttcagacctgattgacgggactttaactcatcaattttagccttttgagcttccattgatttagctaatccgtctaccctagctgaggccgccttttgatactctccagctgattttaaggccgtctcttgggctttccaaccactagtgttagctttaacctcggctgtcaacgtctttagtgatttaacagcttctgctgaatctaggccaaccttactggtcatctcacggccaactacttttttagccattcttttttaacctcctttttggcacaaacgcttataagccatacgtttgattaatggcttctagtgggtcgactaactcagatcggtcttcctttttacgagcatttaaagccgccatgaaatcaaaaaagggactatcgccaaattccttagttgatattccctctaataacaattgcttacccagcaaactaaaatcttcttgctgatttttaagtttcatgacttctcgcttaattttaacgttacgtttgtgccggtttattttgacgacttagcgtctgccattgccttgcgttgtttctgctctgatagtttaatatcagcgtctgagataccgtttaagcgcataattaggtagccgataccttcgccaaaccgttcaattgagatggtatcgttaatcgtttccatctgcttgtcagtgtatcccattacacgttgcacaaaatcggccatatcgtcctgcaattccaggccgtttttcatggcgtctagttcagtgacctctttttcagtgtcctgtgactccagcatgccaatttgaacctttgtagctaatcgaatgatattgttagttggtgttacatccgccgtcttgttgattttaaagtaatttttagcattgattttcattttaatttgtacccctttatttaaatttgtatgtattaaaaaggccacccttagtgggaagcctttaaagtgttactagtgaccagtcgtatcgccagttgtaccgctggttgacttagtgtagccgccaaacgtttcagccataagcttgtctaaatcaaagccagtatcggttgacttggcaataacataaggttgttgtaccccattagcggctaggaaaatgtcactctttagtggggctaataccgtaccagataaggccgttgagtaatctgcttcactgttagtatcggttgagttgttagacgcttcttcaatgaattcaatattgttaaagcattcatagattgagatgtcaccatctaatgattgactttctgcaatcatcgcaacgtgtggcttaggtagctggcgaacccaggcacctgtattagcgttctgagtgaatcctttaagcatttggttaattttgaagtctaagtctaaagcagttaaagccagtgtaggcatagacttaccatagctaaccctcttgatttggccgttaccccaaccagctgtaccagcggcttcaatggcggatacgttaatttggctaaagccttcaccttgatggtcagcaacatagatgccgtcagtagatagacctttggtagcgtctttaattaagtcgccattatcgtctagcaaagcaaaggttgctttgacaatgttgtgttttgacatttataaatctctccctttaaatcatttcgtttttagttacataaattgttttcgttacttggtttgtatccggatcagttgtgtgatgctgactagatacaattaaccagccggcctctttaaggctcttcattaaagctatctcagcttccaatggattaaagtcatctgctaaatcaaccttataatagatttgaatttcaacacccattgctaggcctttaaacgtgctgttggctagataggccgggcttgaatcggtctcttgcaataacatgactgtactagtagcattgtttctttcttctttaggtatgctgttaaggtaaactttatcaacccacgttaaattgagggaatcaactaggctggctatctgggatactggtaataacactagtcatcgtcccccttcttatattcatctagcatggcgttaaagacatcatcttgtgagtcggctaggttctggtcaacaaagtggtcagccttaatgtgtttagtgccatcgtttaacctcatggcattcatatcatggtacttattagtccacccaacaattgagctaccatcatgttcgccgtctatatcgttgctgttatagcttatgttgtcagccatgtgtccgtacttctcatctttatgtgagctgtaatgtttctttctcgtgacttccgtcaagttatcagccaactttttagcaccagctttggttatcttctcttgttcagcttcattgggaactagtttgtggacgtctttaagccagctttctagttggtcgcttatagtgtctgccatagttaagcccccttagtaactagctttaaagtcagatagtcgtaggctagatagctgtttgaatcgtccatgctgtcgttaactacactgtataggctgccttgatattggcatttaataccctctttaacggtgctgttatgacgtataacgatcacgacctcatctaattgctcggctgttaattggtagctactagcaatgctcctcgtgtaaggggcacaccataagctggctgttactacaaacgtctgcttactagtcccgttaacaggattttgaacagttttagtcgtgcctatttgaagcttacggttaaagctggccggtctaagtttatttaaagccatttatccagcccccttagcgaggcaaatcgcatctaagtgatcaagcattagtaaaacacctttgggctgtccgttggttaggttgcgatcataataaagtgcctgagccaatgtgatgatagtccgtgcatacaagggactgtctgcaatatctggataggcagagtattcaatgctatcatttacaatcaactggctagatactaacaaactagttattgtagccacttcttcgtcagtctgatcaatatgcaactcgtcacatacccgcttagctaacgtttcatcaattgtaatttagataaccccctttcaattagccgcccggcttgttaccgtactgtgtatttattagcgactagttaaatgctactttccagtacctgtggttgagcctgacgtagtatcggtcgtgcccttgatgttgataattaagtccttgcgagcttgaacaacgtcttcacgcaaataaatccccaattgttgataccaaacatcataggtatccatgaacttaccggtaatttcgttgtttttaaagttaataaccgccttttgcaatggtgcgataacgatattcacatcaccagctttagcacttgggaacaacgtatcatcaatcacgataactgttttgccaagaattgtactaccagttcctttggttaagtcaggttgaaccaatggacgcccttgcgtatctttcaattggtctaaagtgttaaatgcagattgagacaatacaattgaagcggctgcactatcgttaggcttcaacgtcatgttaagtgccgtcttgatagccgcaactaaatcggttgcttccacggcggtaacaccgtcagttaatgccttgataatcaatccatcattagtgttatcgcgtaatgtaattaagctttgggccaattctgattgccaatcgtagtcagaatcactgagtagatcctgtgagtacacataagcaccagtgtaagtctgcaagtcccaattaattggaacaatagtaggctttgtacccggtgccgtagtcccgtattcagtatgttctgctagtttttcatccgtatcccacattactggcaacttaccagttgaatgcttaacagatacagttcgaactaagctacctaaacgtgggaactggtgtgtttcgtgttctacgtttaaaatatcttgtggaataagtacggatccatcagataagccaatgcctccagtcacatcacgtgtcgttttaccattttttaacacagaaagcatatcgcgcttgtgaatttccagttccttatctttagttaatgtcttcacttttcctaaccctcttttatttttagtcttagtttttgagtcttcctcaagttccgaatcatcagaactgtcatcatctgatccaccatcgtcactattatcaggatcatcatcccgtttggcgcttttagtctgctttttagcagaatcagtagtgtctttgccatcatcttcggtactatcaccatcttctttagctgaattatccttagaatccgtcttagaagcacggttttcttcttcacttagcaatttcaaagcttcgattttttcacgcagaccgtcacttttactgcgtaatttctttacttcatcgacactgcgtttgatttcggcaatgtcactatcttccttgttcaaaagtgatcgtgaagcagccgttttagcttttaactcagcttcattttttgctagttcttcttgcaaagtttcgattttcaagtaatgtcactccttttctaataagtccaacaaaaaaccggccttgagccggtattgttgatcatcgttaaattgtttaagccctcgtgataccgatactgaggtttgcgtgtaagcaggcaatgctgtaatactaatttcaactaattggtcaatttgattaacggtatgaataacattgtcgttattatcaaattcccagtcgtcatcagcaatcgtgaagccgaatgagcagccttttaagtttccattcttgatgttttcataaacatctcgtcctaacgtcgtgttcggcatgttcaatgtgaataaaacaccgttctgatcaacctttaattctagtgagccactatcgacccgtcctagaatgttgtctaagttgtggtcatacagcgcaatgacgctgttcatattgacaccgtcgaaagcgtctggactgatatactcggtaaagcccatgtcttcactgggtttgccaaatactactgcataaccgcttacttggccaattgctgtggtatcatcacttgataaatcacgagtttttaagtcttgaatgtaaatgctgcgaacattttcatccttatgaatcttggctgccgataattccattacttatcacccccttctcggcaagcaatgtcttaacttcatcagcattgaacacaggatttgttcccgtattgagctttgaaatcatatcaatgatttgactaccatctacgtccgtactgtcacgaacattcaatttcaaatcaggtagatttaacttaaatgccaattccgaaatcatcggattaatataccggttcaatgaactggcgtaaaacgacataatttgctgactattgctttgtgcatctgcttttgtgcggttcaaatatgaactaggaacaccaaacgcttcagcaacccgatcagcagaccagtctaagttgttcaagaacttagctacatcggcattaatctggatcgtactaagctgagctgactggtccataacgatggttttaccggcattttcgccggtattttgttcatcaaagctatctctgatagaatttttggcctctttatcaagtttggcatctgggacattaataatggtacttggattaatgccatttataagtgtggacaatgtcaaccgattagcattttcactaacctcaaccgggtagatgagactatctaaaggcgaaattcccatgaattcttgtccgccaacaatttcacctgtcggcatcaatctgatatgaatcatttcagaattatctgccactacagtaccacgatcatcggtaaaattaatttcataactaatattttcaagaccatctgctaaattgacatttacttgtgacgttgggatctgttctaaccattgcgtagagcctaattcaccatgaatcagcaaataactattaccagttagtaaggcttgaatcaggctagactgccaaaaggaatatccattaatcaatttacttggctgtttcagtaaatggtcatatttaccggtattctgaaatgtgcaacttgcaatatcgcttgaaattaaattaatcattgcaaaaatgtcgacattttggagtgctcgacgtgcatcaacaaaattgtgtggaataactttgccattgctaacgctgaaactagggacatagcctttactgcctaaaaattgtgagcgtttctcaaacatctcaaatggtttataaatactaataacaattcacctcatttctattttggactgtcataacccaaaattatcgcaactaacactagtgcgatgccgagcgcaacccatcccaaaataaggttaaataaaaaggctcctatcacaattgataagaaacccaggcaaataaaaataaatggtacaagtaacactaatttatcgaatttcatattttaacctcactaccagccaaaatcacttttgaaataatcgttaacttcatctggcttcatatttgcaaatgggtgtttagcgctgtcatccacatcacgtcggttaggactagtataccaatattgagcttcactaatggcatcaatgatggcgtcaacacagtcaattttagctgaatgtaccgctttatcgaccttcacgccataattattactggtaagcaccgcgttagtcagactgtattttagaattgggtcatcatacatagcaatcaggccacgaataaattgtttctgtagtagcctagttggtgcatctaacgataaagttccttgtctcaacgttataaatggtatttctggatggttattatccatccattccaccatgggacttgctaaatgggcatcgtagacgaaagacttaacatttaagcgatgttcttcaataaaatctaggaaccaatcgccaataacctgttcatcaatcaagccatctgcatttctagcaacgtcagcatagcccttagcctcagcatcactgtaattaataccatcgtgtttagactttaacacgacgttctgctgtgaatgcgcagttggcacaaatgagtgttggtaaacaaacatcatttgccgttctcctttgaaatatggaaaaatgaatgctaacgatgaatcatcgtctaatcgtgataagtctaacccaacgtaaacatcacgaccatcaatcgtgaatgaatcattaggcacaactgacttctgaatatcatcaagctgtaagtatttgtctttcgagactgccagccacatattcaagttacgattttgaaaccaagcgacattaccagtgctttctcgtttgtctttttcatcaagtaagccttttagcaaccgctcgtgcatctcagctagtccgagcaacggatttgacttttcccatgtatcagggcgatctgtttcatcgattgagtcttgctcccagcaaaggaatagactagtttcagacttgcgctcattatctttttcaatgactcgcgttaatcgctgataatcatgaaacattggcacattactattttcatatgccgttgaaatagcgatcagctgcttattagtttgatgaatttgcccagacgatagcttgcttagaacatcatcgtcataagccgcgtcgccatattcatccaatacagccgtattacagtgatagctatcccatttaccggaattagctgtcaatctcagaatctgattacgtgacttaaagctttgaatcagatcagctgaagcgttgatttcttttgccttaattcgctttctaaaatacggttggctttcagcaaggtaatcgatggtgctgcctaagtaccggaatcctttcttactgatttgttcagtcgtcccagaataagcaaagtccaaatttttacgattgccagcttcaattaaatagccataagtcaatataatgttcatcagataagttttaccgttagtccgtgccactgaaattagcgcataagtaaagcgtttctcaccgctctcgttccgccatccctgcagcaagcacaaaatagcttgctgccaaaccattaatggcataggttttcctgattcaacatcggggcaaaccttagcatagtcaagaatgtgatgacattgtttcaaatcatattcataattgaaagcatcatcatagaagctccgtttcaagtcatttagatgacgaaataaggccaatttcatttttcggcctgacgtttgtttgccactaagcactagataagcataagccgtagccgggtcacgataggctttccaaatttcatcaaaatacccatcggcgtccagttttttgaacacggcgtcaacttctacggcccttttgctaaaatcaaattgtttaactttagaacttgtcgtcatcatcacctccaaacggactgtcttcatcatcatcgtcagaatcactaagctttagcaactcagcacggctttgtggggttaaccccagttcagaactaattgccctgatatttttggtagctttatctaagctgtcaacagccgggttcttcttaatggcctttaactcttttccggtaacttttccatcatcatcagtgaaataatcgaacgtttcaaactgtgcaccatgttcacttatgcttttagaactacttcgcagtacaaaataattatcacaaagtgcttcgaccaacgtcttatccatttcattagcaaaagaattgtcttttaacattggaacaattcgccgccacatatatcgggcaattccctccatatatttcggcggttcgtcaggcaaatctttaattttcaatcaaaccacctccatatcttggttagggtgcgtatagcgaccactttttagtgattttatgtatgtaaaatgccttaacactgctaattagcggtctattagggcacctcaaaaaaagttttcaaaattgctcgcgtaaaaaggtcgccggcatattgtggttgctcttcgcccgaacaccggtgggggggcatttttaatcatttttaacctgccagctttgtgattgccattcatctatagttgggttccacattcctaaatcttcccacactgttggttcatttaacttggtgccccataattccaacggtaatgttgttggataatccttgtttaatctaatctgaatgtctgcccatgtattctcttctaaatgagctgatacgcattgctcttttagctttagtaattcactaactgcgtctagtaagttcatttaatcttctccttgattgctttgacccaccagcccttgctgatatgggctagtttgttagttccgttaggttggcttttaattgactcctctaattgcgtcttgatgttgtgacaccgatagcatagtgtccacaaattgtcctggctaagccgttcctcattgctgactttcaacggatgaatgtggtcaacaatcttacgatcagttactgcattaccacacacttggcatgttgccatatcacggctataaacgtaatctctgacgttctgccattgcttagtgtgatagaacgagttagcttctgggtcacgtctaacgtgattataataagcctgatggtctttgcgtacttgcttacccgtatctgtttggctttgatggtttaagctagccttgtaatcagccttacgttgttcgttcatcgcttcgtgtttatcacagaacgattggtcctttggaactaccttgttacaaccgccccaattgcaatgcttcatcaacgtcatagcatgttgcacctccttatttttattcaaactaaaagcgccatgctgtttagcacgacgcttcatccatttatctaagtgggcatccatctccgcttcttgtggcgtgacgtagccgtattttgtgttaatcatctttgccatggcgctctccactgtttggcacaaatggatattcgttaccaaacaaatcgatatttacccgtttccaatcgtctttaattgcttgccaatctttcgtattcattgtgctgcccccctaatcgtatgtatcaaaaaactcccgccaataagcgagagctagtttggagattcaatcgtcaacaatttgaaagggtgtggttttatgaaggaaatggataaagccacggtactttcaaagcgtaaccaagatgttctagtaggattcaataaagtaagcagtttagcgacttgcttgggtcgtaagtggctccggtaggatttgcacctactcagtctctcgacaacggttttacagaccgccacagctcactgtctctgtcgcagagccaaacaagtatccgcattggtttgcgtagttagctttagctacgataattttaagctacatgctcattaacgcctactacttaggagctacctaattagctgttaatgtattacaaggcatgggctagcaccatggctaccaacgttcagatgatttaggcatattttaaacataattttgttttagtatgtctgtagatttatcctactggtacttgactggtcgtttataaacggtattaccgcttcaactacaacaccgacttattgagaatcccgtttggttctgctagttctcacactaacatttacttgggctttgtgtcggcacaaccgtcaatgctttttatctcaaacttgctgctataatctacatatcgaaacagctttttttcactgcaacccagttgtattaaaactaggttcaataattattaggctatcgtctaataacgatcgttcagtcgcagacatgctgggcggaattatcagttcctcatacaccagcttgatacttaatatcgccggcaggcttcgaacctgcatcccattgtggcttaccaattagcccacagcgattaccagtctgtaatttggaggattacttcacgcacgtcaatcacatttggcatactaccaatttaacacgtttgtaggggtcaaaagtgcacgattagtgcacgtttttatatttcatacaatccaaaccccttagcgcaatcgttgataaaagttttctttaagtcgaacgcttttcgacggctaacatttatcatgttatttgcaattaatccgtcgattgtgtattgctgatgtttcttaaagtatagctcatttataattacttctgtatcacggccaacgccgtctaaacaatcatcaattacttctcgttgacgcttcaatgtgttaatgcgccgatcatcgtcaattgtaatgagcgtatttaacgccgtatctgggtacttgtattgtgccttgccacctccgacattatcatcacgtggtacagttggataacgtaattcctgttcacgtttctcgatatacttgtcaatcttgggatagtcacgtagaatatcttcaacttttctaatcgtcgttcgtttcactaccaattcccctttcactcaactccataatgtcagcaatgaagtcctggccaatttgtgcctgttgctcagttgtcagtgccgcgttcatttccaagttggcaactgtggctttcatttggattgctttggcgtattcggtgtcagtcatgcttattcgcccaccaaagtagtaccatactaaatattattaacgtagcagttgcgagtgcccaatatcccaccaattgcaacggggaagaattccaaagaagttcaaatatctgtttcatttgtcttcctccgtcgtatatccgtctagccatgcacgggcaaaagtatccgaattattaacgatccagctaaaggcttctttgtccaaagtttcagcaaacatgaacgcatgaccgattggtaaatcatgcatctgggttaattgaatataaacgtcaacactgtgtggaatcaccggtagctcgccatactgttgctcatataaagcattcgggataatccagtgcgagctatccgcaccggttgcaatccagtcgccccattcaagatagccgctacatagcatgctatgacctacttcatcgtgagggtgccacattccgccactgagcgaatagatttcgtacttatcaattaatccggttcccaattcatcaattctctcaacgtaaactggttgtttcaaataagctttaatcatttgtccgcctccaatagttccgagttctcgtgcacgttgccgtttactgaatacccatcaaaacttattacttgctctaatgggaatatttttccattgcagttagccacataacttgcatagtcgggacgatattctacgaagccgatgtgttcttcttctctgggatcatattcgtccccaacacaccatatgcttccaaaatgcagaatatcaccagcataaatctctttgtcgctcatatctttcaggccggtaaactgttctaaaattagcccatcaccatcgtaggcgtattctgttgaccccttagctcctctatcatctaaacagcagtgaacttgaacgccatcaacaggaccgtcaaagctaattctataaacaactagcattttatttaataaattatcccacgctctaaacttaatcatcgtcgccatctccttctgctatttcttaatcacacggaatttgtgaccatcaacactaatatattggtcaaccttaacagattcatattgacgttttgaaacagacaagcgtttgtgcttgccattaatcgaaacagttaacacgtagcgctctgctttgtcgtgatgagttactgcgcccatataccagaatggatagtaagaatgtccataaactgattgatgactggtgctgaaacccgatttggtgcccggcttaattgttttaacagctgacaccgttttaccattactaatcgtgtgtgtgccttcatcttctgttacatgcgtagtggtgtgcccagtagtaacatgagttgtgtgaccgccttctgtagcatgtccaactgaaacatgtccgccagttgatacgtgcccaccaccaacgtgagcaaacagtggtactgctttaggttctgccatcgagactttgcgattaagatgttccttggatataaccttgccttgcatactatttgaacttgtattacagcctgtcagcgttaacccacatactaataaaattgaaaccattgtaattttcttcatttttaatcctctccgaacgcttcgaacacccgcttacgttcctcgttagttggtcccttgacaattatcatgctatgccgctctctttcatgaatactaaccaatgggttttgccacgtttatcgccaaacagcggtgggtaaccaatagcgtctagtagttcgcttaatttgatttgttcttcgttccatttgaatattaacgtgccgtgaagcttcaacactcgcatacattcgataaaaccttgacgtagatcaaaaggccaagtttcgtccagcgtgccatacttcttggtcaaccaacttgattcacccgcatggcgcaaatgtggtgggtcaaacacgaccatgtagaacgtgttatcgtcaaatggcatgttacgaaaatcggctacaatatccggtttaatctcaattactcgatcatggctagaattgttatcagtagccgtaaccgtttcattccgcttatccatatatgttacgttcggattatgcttatcgaaccagaacattcttgaaccgcaggaagcatccagaatcactttggttcttgacatttacccacatcctttttatttttctcggcatgttgcttcatgcgccggtgcttccttttaatcgttgaacgcttcttagtatgtttaggcataactcacagtccctccggtacacgctctttaatgtacgtgtcaaattgccgctcaattttacgactctctctggctaactgatccactgttgtaatacgttcactaccggtccggattaaatacccacgaagccagtgcaatgcgtcctcgacattcttacaatgcgctaggggtgcttctactaggcgattgatgccagacttatcatcatagctagttactgggtggccctgactgtctaatgacatcctgttaaccttaacttcgtatttgtcactagtcagatgatactgtccaattttcatatcaatcatgtttattcgtcctccgtaatgtagtatttgttttcgtcaatcgcacgaatacggttatccagccaaacgttattgtgctttagctcccgagacgtcctagttttaccctgcttgccttccatgactaatttaatggcattatactgggtacgcgtaatctccatgtaatcgtctgatacggtcttaattccaggcatcttatgcaagttagctaatttgctctcaggcacgttatccatgctgccatacctcgcttctagcttatgaatgacttccaactctttcgcccaatttttgcttgtcataaacaatcttcctttcaaactcttgttcatattgtttatgtttattattcacacagttaggacatgggtcaaatgtgaaaccataactcccaagtggttgttgaacgactttactaccatggcataattcacaacccatacacttctcgctcctttctattcaactaatccgcggtggtctggaatatttgcaaacgtgattccattattaacaccgtggtttttcattctgcttaatgttctgtcaccatatcttgcagttaagtcgctaccaattaagttagtggtcacaatcaccgtcttgttttctcggtcacgccagaatgcatccgccaaatctaacgaatactctgtgccacgttcactaccaaaatcatctaaaataactacatcagcgttctttatctcagccatggttttattgatttgttttgccatctgatcgtcattaaaagactgtttcttgcgttcgataagttcacgccagtccacaaagataattttccaactaaagaacgtttcaactggcttgccattcttcatcacagtctttaataacttgtaaccagaccgctctaatatccagtacatcatgcctacagcaagatgcgtcttcccacgccctgttgcaccaatcatcaacgtgtggattgtttcaccgttaataatacgattagctatcgtacggctacgctctaagacctgcttgctagcatcactcgatgctgtataattactaaagcgacggttaaagacatcaaaactgctaaaaatactgtaggtattaatatagcctagcgcttcgtttttatgtgcggatgctgtcagggctttgttatctggtatttcacggtggttaatgtcttccatatagccgcaactagggcatgcaccggccattttttggcccgtacgcttgtttaaaatctgtggtcgtagtaatggcttcccacaaatgggacagtcaaccccataggtttcaaacaccttagacattaggttagtgactacatcgcctacggtctctaccatggctgatcactatccttaacttctctgccctcaagggtaaagccgttagaccgaccactttttgaaccgccaaattctttccgtggttgatttaattggctttgcccttgtttgtcccttttagcccagttgcgaatggttgccagatagttcttatacgccttaccattcatactgcaatactcagaaacgcgttcgattcggtcttgccagtcagaaggaaactctgatttgagtttcttcaattgttcatccgtcagtaagacattctggtattgtccatatttgtgtcgtgctggtttggctttttttggcttggaattatctggttctatatacttacctttactatccttacctaacctaaccttacctaacctatgcggtccattgtccgtccattggttgtccattggacgtccagtaactttacccgtgtcagcacgcggcttgggctcagttaattctaggtttggcatgatttctaataacaagtctttatatatcgaatccacttttctatctgctcgaattcgattattttcgttccaatccgtgatataggcaactagatcatcgtttaaaacatttacaaaattcttagctactagtattcgtaaatcgtcctcaactgcaccagtttgccgcataactgagaacgcttctacaacaccatcatcatccgcatgcaaccccaaatggaaatagagtgcctgactgctcaacggcatctttaaaaatttagcgctatcggttatacggttgctaaacattctcctttgtgccatcttttaatcctcccttatttactagtaggcattccacctacccggtgtattagtcactgctgtatttacctttcaagccaattcgttctagtgtttctaaatcacatttttatcttttaaagtcttcagcaaaaatttcccaccagacaagccttcatccgcatcttcaaattgctgttgcaacccacctaagtaaccttctacctctaataacaaccagtcatattcgttaagtagtgcaatcttttcctcatcgtctaggtcgtcaaacgaaacaatttgttggcgtgcctgtactgccttgtaggcaaagtcagcagcacttgtagctgcagataactttttttctacacgattaagtttcatttcaaatgattggcattcagatagtaagtccaccatttatttcagccccctattaagcatcaaaacattcaagtaaaatgccatcgccatattattttcgattagccacaattctggagttaattcttgtggatcgattgatgcaatccgtgtaataccatgaagaatgcaatcctgttgttctttgtaaggtaatggattatccataattagtggtctctctttcttaacgcttgcaaacattttgagttagcgttaacatggacgttaaccttatacattgcttacccactactcttgcatcccactccagtagtgggattttttgtcttttgacttgcaaacgagacagctttggaatagagtaaagcttagtactaatcatctcttccattagtccatcgttagccaatactagcgatggctttttttgtgctcttttccactcgtggagtggtaaaattgatactttttgcatgattattcctccatttctaatgcttcttgccaatcaatgacatagccgccaccaggacacttgctaactgaaatatcttcttctgatgatagtgtgttgataacgccgacactaattccagacttgttccagatgattgagtgatggcctgacaaactagcaacattcatttcacctagtaaatcatttgcttgtgccttgtcagcattggcgactaatttattgccaagcccaacaaatgcatctgtgtctcttaccattacttttcctcctaaattctatttgttacagtactaatgagactgaactttgtttgcttccatgaacttatcagcgtctagttggtcaatacgcttagtaccgttgataattacaactggtaaccctttatcaatgaagttcttcttaagtgtgttacgagacttaacattgaagaacttgcaagcttgacctaaattcatatatcttggtaagtgttctttcatgcctatttcctccttaaattccaaaccagtttctaatttcacggcgcttgtaccacacggttgttagcgcccaggttaataccgctacttctaccatggcaattcctccttatgaattgaatcatcatctacccgcctaggttttaatcacttaaattttgatgattcaataaccatttttcgactgctggggcgtaccattttccgtcttcttctggctttgggaacccttctttgtcgcgatagtgcttgtcgaatgtatcaaccttaatgccaaactcagagtagaaatctttacgtccaatcattttatgatcaacagcttgttgactacgcccatccgcgatgccttgttcatatgcttgcgtgaagagcttcgacaaagcacttatcaaactgtccatcctggtcactcctttcggtgtataattttgttagtccaattaatcgaggtgataaatatgaagccctatatcataacttatgatttagacaatcctggtcaacggtataaagacgtcaaacaaacaatcgataattttggtggatctaatatcaaaatacaaaaatctgtttggctggttaggaatgacctttctccggacgaaatgacttctaggctaacagaatcaattgatgataatgattctttgtttatttgtgaactcgttaaaaactaccaagggatggccacagatgaaacttggaagtttattaaagaaaatatttttccaagtcaatagtggtttagtatttttttaccagtatgttctgaatcctctggaataagcttttcaatacccttgacaggtttatgatcatctctgatctgtctaatggcttccgtgttatttgcgataacatggaggtctttttcaattgcccataatacgtgtactagttgctttagtgtttttgtcatattgctaatcctcctatgctggttccttgtcgaatctaagtgacgtctgccgaataatcgtcttagttgctgtagatggctcccagtcgttgatgaagtccattaccatctggtagtccttcttgcgcagcattgaccgagcgctcacgttagcaatcttcttgattccactgccaatatccttgaacagctcacctcgttgtttctgtgtgatatggccatagctatgtgcgacttccgacacgcgctgattaacacgccggttaagcgcactatattcaggatttggaataacttggttctccttgaggtctttcacatcgccctccacgctatccagtcgttgattagtttcctcattggcttgcagtgccaatctggcaatctctcgtggcgatgttggcagtacaaactgtttcgggttaaagtagttttcttccagctcatcaaacatgtcccaagcttgatcagttccaagcatttttgaatgccggctagcaccacgctttgtccaaagaattagtgttttggcgttcttcccaacaaggtcgaaaatttcgaccctgtctttgaactcttttagagtttcccctgtcaacaggtaaaaatgttttcccttgacaaatttgctacgattgttggcaaaattttgcttaatacgttgagacgttgttccataaaactcagctaactgttcagtggttaaaattagatctccgttaaatttaacttgttgtacttcttgcatgtggatcattcctttctatgctggttgtttgtagtccattggcgtaaacaaaaacttgatttcatattcagggaaaaatttttcttgaatttttaaagcttctgtaaatttgaacgaagacttaccatttattttgtcagccactgtctggtatctaacgttcaacagatcggcaatatctactaaagaaacgtttttttcttttctgacattgttaagattattcaacatattttccttcctttctaagtacgaaaattcgtatcttttaataaaaaaaataaatgccctccttgaacatgacctaataatatacgaattttcgtatctagtcaatacaaaaattcgtatttttctaaataattttatatacatacgatttttcgcatggtacaatagacacatattaagggagtgaattgatttgaacaaagaagaatatttaaaagatttaattgaaattaaatacggtaacgttaaatctttttcggaacatgccggattaaaatacaccaccgttcgttcaattctagaacgtggggtgttaaacgctaaagtagaaaacgttataaaaatttgtgatgccttaggaataaagccagaagacattttaaaagtagaagattccatcattagcgatactaataaaaagatgattcaattaagctctgatcgtcagcaaaatgtttacaactacgctgacaatcaattaaaagaacaaaatggtaaagtcgttaatttgccacttgttggtaagtcagccgctaaccctactgaattgacctatggtgatgtagaaattgaacacgacgacttcactgacgtgccacacggggctgacacagccatccgtatacaaggtgattcaatggagccactgatccacgatggtcaaattatcttctaccatcagcaagaagaagttgaaaatggcgagattgctattgttgaaatcgacggcgacggtgttacttgtaagcaaatctactacgactacacttctgatgaagtcatcttgcgatctattaataaaaaatacgaaccacgtcatgttaaagatgaccaggtacgtattataggcagagttatattataggagcttattgctcctatgcttatgcgttaaaaagaacacatgttctacatatttagcggtattatacttacataagaccagatacggatgtcggtaaaagctgggggaatttggaggaattattgaatgtttataacaatttttgggtggttaatcattcttttagctgtgggggcttctgtcggtgtatttttaaaaaatgaagacggtacaagtaattcaattagtcaaaaaatactgacaattgttgtgagtgtgttggtaatatttttcggactgtatttatctggccattctaagcgcgttaatgaggcaaagcaagagtctattagctcgtcacgaaaagaatcaataagtcaatctaaagaagatagcaagttttcatcaagtgaagataaagagtctagtgaggacgatgagaacggaaaactatttatcagggatttcaatgtttatctttctaacaagaaaatgggaacttcaagtattgaagatggagttgttaaagttgtgcttccaaattcagtcgaaaatatgagcgtagcagattttacagctttagctcaagaaatttacgaccatgctaatactcttgctagtggtgaagactatgatgccggaataatttatttctactctcaaaatggtggcgaactagcaagatctacgttcagcggtggaattaagatttttaaggagtaaccaagtcttgaaatatgcacataagacttacgaactgattataggaatattggctctattctctgtagcaattaccatatttgatttttccggagttatcaacttgaatagcactccatggaatatagtcgatgatggaatactaattattttcacattagattatgtgagtagatttatcgaggctacagacaaaaaatactttttcaaacacaatatttttgatttgctagcgataataccgtttaattcaatgtttactttattcaggttttcaagaatgttccgagttctacgattattcaaattatttaagtttgttagacttattggatttattggtaaggcacaatctaagttaaaaaagttctctaaaataaatggttttatatatttgctatgggtatgcctagcgatcttgttcatctcggctacgctatattcgatagcagaaaacgtttcttggggagatgcaatgtggtgggcaatcgttacatctacaactgttggttacggtgatatttcaccacacacattagtaggaaaatttgccgctgttttattaatgctaattggtgttggctttattggtatattaactagtactatcactagttactttgccaaagaagatacttctaacttcgacaagttatacgctgaaatcaaaaaattggaaacacaaaatgaaattattcaggataagcttaaagcgttggaaagcaaacaggaggataaataatcatggcattaattggatttactattatcattggatggttagtatataaatttttcactaaatggctatggtggttcatcggatttggaatattagtgaacgtgattgtttggtttgaagcatacggttggattttgtttataattggatgttttgcgctggcaattgccttatttgctcttgctattcgcaactatcgggttcaacaccaaagcaagtagaaccctcgcccactaccagcctagcgggcaacatgcgagcgtagttcaacggtagaacagagttcgtctaggagcccccactcttaaaaaacatcacgcaggttcgactcctgccgctcgcgttgtaacaaaaaagcacatccgctcccgccaagaagatggatgtgctaccagtaaaagccagtggattgctccgctctttttacatacataatattatcacaactaaggaggtgatgcctgcaagtccttaaaattctacccgcctaggtgaaatttaaggaggaaatataaatggcaagtattaataagcgtggtaaaaaatggaatgcgcgtgtttcatattacgatgatttaggaaatcgtaaatttatcaatcaaggtggttttcgaactaagcgtgaagcccaagaatgggctaaccaaaatgaaattgatgttagcaatggtataaatccaagattaggtaagcaactatttacggattactttttaaaatggtatcagacttataaggagccaactttagcaaagtcaagtcgcttacgttatcagtatacgcttggaattgttaataattatttcgctggcaaacgattagatgaaataacacgtaccgattatcagaagtttctaaacgattatgctaatcctgtaggtcgaagccctcgttcacttagcagctccgaaaaagttaacgtgcaaattaagtcagccgtccaatacgctatcgatgatggcattattaagcgcaattttacagcgcacactaaaattagtgggcgcccagaaaagcctaaagaaatgaaatatttagacggtaaagacgcggaaaaactgactcgtgcgcttgaatcagacttaacatttgctcatttaactaagctgatggcgttagttagcttgcaaactggtgctcgttacagcgaagttgccggtctaacatgggactgtttctcttttgacttcaaaaccctgagaatcaataagacctgggatacattacaacgaaatggattcgctgataccaaaaacgaacagtccaagcggctaataaaaattactgatcacttagctgatattttgaaaagttttcacgccctgcagattataaagttagaagaactaggaattgataatccacttgatttgatatttattaatcagtatggacgtgtaccggacaacacaagcgcaaatcagacgcttcacagagttttaaaacgtattgggtctaaagatattacctttcacggactgcgccatacacacgcttcatatttgatttacaaaggtgtctcaatttactatatctccgaacgattgggccactctaattattctacaaccatccgtgtttactcgcaccttttgcgagaaatggaaaaaaaggagacgggcaaagcccttgtggctctaagttcgatggacggtttggtgcacaagtcggtgcacaaatcttacaaaaacgcctaatgtgcaccaaaatgtgcaccaaaatatccttttataccgtttttcagcgttttaccaaaagcaaaaaccgcttcataccaacgttttaagttgatacgaagcggttagtttgatataaatatgacctcacccggactcgaaccgggatcaaccgcttaggaggcgggtgccctatccagttgtgctatgaggccattaacaatccgtaaaatatcatctcacggattgtgcattttggcaattactgattgctaaagcgatcacgatttttcttgcgcatcccttttttcttagaatgcttattgtgacccttcttctttttaggtgttgccgcagcgggccgtttccggcttgtctccactcgcttaacctcatctgggtgaccagcactcacgacccggtgccgaccgttagccgcgttgccagccgtttctggatggtcgaacgttaacggtggaacaactttatctggtttcgtatcaacaatatgataatcaaccaagtaacccggcttgatttcatagtcggtcgtcgccatcagcttcttaaagtcgcggacatcatggtcgtcaccgaacgtcaagactagtccatcagcacccatgcggcctgtccgaccgctccggtgaatataagtcgtgacatctttaggtagctgatagttgatcacagctggcaattcaggcacgtctagaccccgagccgccaaatcagtggtcaacaacagcccgactttgccttgccggaataaccgcaacgctttttcacgttcaacctgacgttgattactggtcaaggcaacgtaactcacgtgctggtgtcgtaattctaaggcgacatgttggagttcctgcatcttattgaagaaaacgagggcccgcatatggtcaacacgactaatccgtttcagtaagtccacccggtgccgattacccacttgcatcgtccggtgccgaaccaccccctgggtctgatcaatggcccgcacatcgattttttcaacatgctgaccaaaccagcgtggcaactcatctaaaattttagtttcggttgctgagaagaagcctaattgtaacgtttcagcaaatgtagcgtcgagaatttcacgaatctgatccaaggtttcatctgtcagtaattcatcggcttcgtcgacgatcatcatcttcaaatgcccaagcttgatcttaccatccgcaatcaggttagtaatccgccccggcgtcccaacaattacttcaggatgctttttgagcttttccatctgccgcttaacgttagccccccccgtaatcgcgaggactttggcatcgatcaactggccccactcgcgcaccacgttggttgtttgcattgcgagttcttgtgatggcgctaagatcagtgcctgcgtgccttctccgacccgcaacgcttcgagcattggccacgtaaacgctagggtcttaccagaccccgttggtgcgagtcctaacaccgattgaccagctgcaagtggctcggccactgccgtttgaatcggcgacaactcggtgaaccccgccgccgcaaatttagttttaaatacgtctaacatagtgcctcatttctatttatcggtatcaggggcttcacccgtaaaatataggtgccctgactgccgcaaattaaataatagtttattaacatttcgactaagttgccgccaagctaagtattccgtctggtgattgcttgggtcattgataacggttgcgaagtcgcgcgcctcggccagcattggattggtatcgggttgcgccccaatcgcatgctcctgaccatccttatcttgataagtgatttgtccaagttcagcaggattatccatcacaatagcgtcgcgcagaccgttgatttcagatggcaagaacgaattactagtcttaccaacgttcaaggtcaccgtaaagtcagcgtagcgtaaaatagccacacccttaccgtcaacgcccgttcgaatcaaggttgggtagtaagccacctcttccggcatgccgaaccagccgaccgcatcgtaggccaggtacacacctaaatcctgaagcgccccaccggcaaagttcaacgagaagatattcggttcttcaccagccaagacggcgtcataccgtgacgagtacttcatgtaagtcaacgtcgcaccctgaactaaggataactttttaatctgatccttgacgcgttggaaattaacttcgtgaatctggcgtgctgcttcaaataataggacatcagggtgagcctttaaaacggcatctaactgttcaaattcttgttggttcgccacggctggcttctcgacgatgacgtgcttaccataggcgattgcttgtttagcctgggcaaaatgcagactgtttggtgatgcaatgtagaccgtatcaaaactaccccgactgaaaaatgcatctaaatccgtaaaagtctcatcggcatgattcttggcggcaaaagccttcgcggtctcagcatggcgggaataaacactcgtcaattgccattcaccagaggcagcggcagcatcaataaattgttgtgtaatccaattcgttccgataattcctaattttaacatcgatttgactcctctcaacggcgctagtcaaccagtcgtgattggtggcgcttactcgtgcgtttagtttataattctattttaccagttttcgccgttaagttgggccataaggatcaaaagtcacccgctattttgcgcataaaaaaagagccgccacacgggcagcccttttaaaagctaagcttattgaggaacaacgttagcagcttgtgggccacgatcgcttgattcttcatcaaaggtaactttttggccttcttctaaggtcttgaaaccgtcagtttggatagctgagaagtgaacgaatacatcgttgccatcttcaccagtaataaagccataacccttatcagcattgaaccattttacagtaccatttttcatgaactaaatcctcctaggatataaaaataaaaagtaactaacacatgttattaacacctataaagaatttacggtaacacaattaaatgatactttaaaacttcacataaatgccaatcacattatatagattaacacactcacccagtaatttccaatcagaacacaaattaattcaaaaaaattagttaccgcccttccgaaattgataaaatattacgttcattacccgcaggtaacagtgacataaaggctttaataagaatccacttattacgtgacgttaacgccgttttagtggtatattttaattatagatttattcagaaagaaggttgatccagtgaagcggcgtggcgcaatattatttggtttatcattacttgcaggactttctagtacactactccacaaacggcaccctagtacgatcgctgacggtgacttagcggttttctacgcgggaacttggacctatcgtgatgaggctcatcaccgggaccacacgttggagattgatcccaacatgatgattcgcatcgacgggcgctcggtaccagccaccgtcgaatccatctcatcgagtgcgctcgtcttacttgatcaatatggatttcaccttgaggtgcgggctaatgagcaacgacctgtaaccctctttgacgaagccgatgatcgcagttatgtcatcttatcgccaaatacctaatgacgctagtgacgtcctaaggattttaataggtcgccatcaaaataagtcgcaagttcaagaagagtcttgaacttgcgacttatttttagtcagcctagcagctaataagctgttaatttaatttgtgaaataagttattcaaggattaggccttaatttaagccctgcgccacaactttattgtacgctgtcacactaccgttgaatagaattccagcgaactcttgacgagtcccgttctggcggtaaacggcgcgatcggaataatgcataaacatcactcgttgtccctgttggtgggtcttcgccgtgtccagccataagtcagtgtcttttagtgcgggcttaacgatctgcttggcaactgcgggcgttgaccatacgacgcaggagcgattataatcctggttcaacgtggtcactaatgccttaagcttggcacgactttttcgaaccgcaatcgtctggtccgtgtagtcaccgtagtattgcacttgaatcgcaattggtaaattgccgatgctatccccgaccgttttctcgaaataggccgcttgggccgcagcagtcgatgaaaaactaaacgtatggattacgccaacacctaaacttgtgccaacgattcgttcataattgcttgcaaagttatcatccgtataactagctccttgagtagcgtgtaaatagacaaacttgagcccatcattttgcaaggccgcaaaatctaaataaccgtcattttgtgacacagcaaccccacggacatcaaacccactcacgacagcgtcactacgccaacgtaaccaagccaagccgccccaaacgctgccaatgattactaatagaactaataaccagcccagtcgataacgccaccgcgcccaccgcgtttttgcgtatactggtcgataatgttgccgctttgtcatctcatcaatcctttgcctacagcattaaagctccgttcgtgtttgactaatggcctcgcgaacccggccaagactttctgccatttcgatattgccatgaacagcagtcatcaagaagagactatcgataatactcatctgggcaatcaacgaagtcagcccttccgaacgatagttaatttcttctgcaactgaaataaaggcaacggtactgtccttagccaggggcgagttaccgaagctagttaacgcgatcactggcacactttgtgaagtcagggtagccagcacttgtagtgtttgctgattacgcccggtatgtgagataaccactgccacgtcgctggcattcatctgagccgcttgcatcagttgcatatcatagtcactattatgggcacacggaataccggtgcgcacaaacttatgatacccatctaaggcagcgactgcggagcccccgagaccataaaagccaatcgagcgagcattcagcaataattccaccgcccgcttgagatctgcttccgtcattacctgacttgtctgatctagcgaactacgaatactattgaatgttgattccgcaattcctttgaaagtcgtttgtttttcgacatcttgaaaagcttccgcattagtttgttcaatcggttcggccgccgttagttcacgtgagaagtcacggaagctactaaaactaatccgtttgacaaaccgtgaaaccgtggccgttgaaacgccaaccgcggcagccaagtctgaaatcgactgagccgccgttttaattgggtcggcaataatatagtcagcaatcttgcggtccgtcacacttaaattcggataataagaccgaattaaagtcaggacccgattgcgatgtactggtgattgtgtggacatttcggccacctccatgaccaaattttaccacaattcttaataacaccctaaacttcctcacaggtgccaccgtcacaaactcttgaacactgtccagtccacaacgactgaacctcgttgccgctcattcgacagtccccgtcgatactaagcccttacgagtctgtttcggcttatccaacatgtaagttctaatcaacgtgacaatttgcgcattttgaggtaaatcggagtgctgggcattcgtaccagtaaccgtaatctctgtaaaatgcttgacttgcccttgatagatatacttgccagcctcgacactccgcgctggaacaagaccgtctgaatcatagttttcggtacctgcgaccgaatacattgtcgctgacttaggcaatcgatcgcggtacttaataaagtcagctaacatttgtgtcttatgattcaaattagcttctgagaaattgtaaggtgagccaatggtcataattcgtttgaccttaatatcgtcgcgattaaaatagtgttcaaagtagtacgtataaatcagaccaccattcgagtgaccaattgctttgaaattattgaattgatacttggcagccaacttcttaaaggccagtgagaaccaacgggcctgatgcttaatattatcatagccgtcacgattattttgaaagccaacgacgatgattggctcgttatcacgggtacgcaacgaccccgtcattttaatcgtatcatccgtcatcacggtcagcttaattaaactatgccgacgatgatcagccttattaagttgcttgactaaggtgtcaaaccgattctgagtcgcactactgccgggaatcataataattggtgacatctgcgaatcatggcgtcctgccatcgcagccacgttggttttcgtccactggtatgagggctgaatcaaaaagcccagaaatagtaagcctaatacaagcactaacagacttcgccgccgtcgctgccaattaggtcgattatacatgcttagcaccccccacttgtgcttgcgccgcctgcacaatggtttccgccaaccgcatgaacggcaaatagatcaccactgatagtgccaaatcaacgataccaagtaaaagtgccaccacgttaccgttagtgccgataaaggcaatcaacggtcccggcgtacccacgggaaccggataaaccacgggtggaatccaatgaaacccaattgccagcgccgccagtcccatatttacgacaggcgcaagcacaaatggtattagatagattggattatatagaactggtaagcctgtcagtagcggtccattactattaaagagcgcaggtaatagactccaccgcgcgactacgtggtagttatgattgttgctaccgatataaatggcaatcactaaggccagcaacatccccgttccgccaaacgtcccaaatgcgtgatacaacgtgttggccgtatacggatacggcacgtgatacgccgagtgatgtgtgagtgcataattcaaattggccgtcattgtcgcactgttagtcaccaagcgttcttggtacggaccagctagtccaagaatttctaacaacagcgtcacaactgccatgccaaaggtcagccacagactgtgactagtcgttgcgtacttttgaaatgccgaccaactttcagcagagtacgtaataatcatcagccagttcaaagcgaggctcactagcacggccaatactagtattaaggccattggaagtagtgaactgaaagtccgtgtcaagatatcggccgtatgcggactactttgtgccggaaccggcttgctgaaccatttgaagagcaggccggtcaaaccacccacaatcaatgcgcccgttagaccgttagtcccgatcaataaagtgttaaaaacaccaatttgattttgattcgtatactgataagccacgatcaatagcgcaatcgcggcggtcaatcccgctagttggtcatcgcgctgattgagtttggcatggtattttgccgcaccaaatgctgctactacggccacaccgttgagcgtcaaggttgttaaactatcaaacggatagtgtaagtaacgatagtatgggacccattttgacaggtgaaagatactggcaataaaccccgttttcgtcaacacggtcagttgaatgatttgactgaacgtcccaatcaaaatgaatgggaacgtcaacatcaaggtccgttgaataatccgatagaagttagtttgccgaaaacgcaacaagcgcggcactaaccgttgaattaaccgttgttcatcaagccacacaataccgcccccattccggtaatctactgaacttcattataagccgttttagacgctgctgcctattaaaatctgttataaatttacatgctatgctggtatcaaccatacttatatcggattgttaatttaatctgactggtcaacaacggtgtggcttacgctgagacagcaatctgattacaccaaaaaaggccacgccgtaattgcagcgtggccccgtcacctaaatttgatcgattatcgccaattgatcttgctgagaacgcgttttcctaagccattttgcagaacaatgaacaccggatacgcactgatcatcagtggtaggtaaatcacagctaacgaccaatctaataggttaaccaatgagaaaattcggccggcaaacaaaaagactaggacgaacagtgttgccattaacacgactaacccaattttgaaccggttcaacggccgggctgcaatcaataacgcatttaaactaaagatcccggtcatcaacacactcaacgtcgcggtcgtttcgaaattcagctggaacttattacctaacaccatgatgaccatgatatagccgaccacgcagatcgccgcgggaacggcaatctccatcacctgtttcataaagcgcccggtaattcgcgtataatcaggctgtaacgccaagaaaaaggttggaataccaaccatcaacgatgaaatcggtgttaattggatgggctcaaacgggtagctgtggctcatgaagataaaaatcaacgtcagagcgaccgaatacatcgtcttaatcaagtagagtgcggcgacccgttcaatattattgataacgcggcgaccctcgttcagcacttgcaccatcgcatcaaagttcgaatcgattaagacaaaatcagccaaactcttcgtggcttcactcccactcgccatcgcgatactacaatccgcctgtttcagcgccaacaaatcattaacgccgtcaccagtcatcgctacggtatggccgttgcgctgataggctttaattagttgctctttttgttgcggcgtcactcgaccgaacaccgtataatttgtcactagctgatcatagtcgggggtagtccccacttgactcatatcaaccagccgatcagcgtccttgatctcagcccgttgtgcaatactggcgaccgtcaccggattatcaccagaaataacttttagggcgacgtcttgattagcaaaaaaaccaaacgtcgtcttagcgtgtggccgcaactcatccgtaatcagaattaatcccaaagtcatcggtcgagtcggtttgggcgtcgttaaggcggccacttcggctaacactaatacccggtaaccttgttgcgcgagcgttttgatgcgagactgtaactcgccgggtaccgtggtaaaaataaattccggtgcgcccataacgtaagcgtgaccatcaaacgcagccccactccacttacgacttgaagaaaagggaagaacttctgtcgcttgcactggtggctgaccaaaagcagtcttgatggcccgggccgtttcattatcatcatcaatagcagtgactaacgcagctaaccggtgctccactgctgtcaaatcatgctggttccacggctcaacgcgttcaaaaactaacttgccactagtaatcgttccagtcttgtcgaggcacaacgtatcgacccgggccagtgcttcaatggcgggtagctcccgcaccaatacctggtgccggcctaaagtgaacgccccagcagctaaagcgactgacgttaacagcaccagtccttccggaatcatcccgaccatcgcggccaccgtcccgaggattgcccggttctgactttcaccccgcatcatagtggaaatgaatagtccagcacctagtggaataatcgtaaaagtcaaaattttgataattcgattgataatcgttaacaattgacttggcgtccgccgtttttgcttagctgctcgcgccatctgcttgataaaactgccgtgaccaacctgcgttgcctgcacgattccgtgaccaccaaggatgacactcccagaaaccagctcatcacccggccccttaataaccggatcagcctcaccagtaatctgggactcatcgacctctaatccagcggtcgcccgcacgagcccatccacaggaatctgctcgccacgggtcactaatagtaaatcatcctgaacgatttcgtcctgaccaatcgccaccgtttgaccgtcacggcggacttgaaccttagtggccgataataatgccagcttatcgacctgacgcttggcacgaatctcctgaaaaataccgatggccgtgttgacgatgaccacgaataagaacagcatgttcttatagcttcccgtcaaaaagactaatccggctaacaaaacattgatacagttaaaaagtgttagcaaattatcacgaaaaatctgtttaacagaccgcgttaagggcggtaacggctcattctttagacccgctgtcaggcgctggtcaacttgcttagtcgttaacccgtgttcaattgctgataaataacgttccgacatggtgggcccccttaaaattaactttaaccttattgtaaacgattttttaagcctggggccaaaataacgccctaatttagcgtttaccatgcagaattaagattttcattacgattgatcataaaactacttcaataaatcattattgattttgatttcagccttaacaaagattattgtattacgccccatttactgctaaatattggcgaatttaacctataaaaaaacggctatctgctaagatagccgcactgaatcttaaattattttttcgtcttatcagcaggtaagtgtgtctggtcaatcgctaactgcataaccttcgtgaaccgttcatcaagttcagtcccctgcatcttaaagaagccgccaatctcttggataatgaatccgaacaacgtggaacggtacaaggtattctccacccgcgccgaatcatccagttgtaatggtttaaacatatcctggtataactgcacaattgctttacgagaccgtgggattcttaggttatcatttaagtcaagtaataacggtgccaacccccgatgctggttgcaggccgcccggaattcttgagcaaatgccatcaaagcctcatcaccgtcaacgtctgagattgtttcagttaaacgatccgcaacattttgaacaaattggaggccaacctgatctaataaatcactcaagctatcaacataattataaatcgattgcggccgcacatccaaaactaacgctaaatcccgaattgttaatccgttaattcccttgctttcaattaactgattagctgttgctaatacttttgcctgtgtcagtgttcttctctttaccatcatgctcccccatttatcggtttatttcgtttatcattataacccaaactggtcaaaaaccgagatgaaatacatacttttatcaaaagtaatacaattgatggtttttgtgggtgttttttgaccaataaatacaattatttaatttaatacgctaaatttgactcaaacagctccagtgaactagtttacagcaattacagcgcattatttattaaattatttaaagcaataattataattatcaataaactgttttattagccgattctaaatgatctgtctattaaaatcggacgaattcaaatcaatatcagcgcttaaaaacggttattttgtgcttctaattcaaagttagccctcaagctgagtaaaaaagtgtgttggttacccgacaaataatcaggcacccaacacacttttcataatttcattaataatccagttttaaaatgcttattgttcgcgttctaacaccgttaccgattcaatatgtggtgtttgtgggaactggtccacgggttggaccggggcactaatatggtagccgtattctgcaaaccgttgggcgtctcgaactaaggttgatgggttacaactaatgtaaaccacccgtttaggcgccatttcaccggcactcttgataaagtcggcgtccaagcccttacgtggcggatcaacgacgatcacgtccggcttaacgccatctgcttgccatttagccatggctttttcagcgctatccaaaacaaaggtcgcgttcgtaataccattcttatccgcattctgccgtgcgttatcgatggctgctggcacgatttcaacaccatacacttgcttggcatgttgggccatcgttaacgaaatcgttccgataccggaataagcatcgatcaccgtctcattacccgtcaaaccagcttgatcaatggctaactgataaagcttttcggtctgttgtgggttcacttgatagaaggactgggctgaaatggcgaatgtcaggcccagtaactgatcatcgatagtggccttaccagctaacacgttgttaactggccctaagatcacgttagtcttcttagaattaacgttttgaatcacactgacaacttcaggtaacgctgcttgaatctcttgtgtgaccacgtcagccattggtaagtgtttcgttcgcgtcacaataacaaccatcatctcatgactgtaatacccacgccgtaccatgatcgtccgaatcgtcccactatgatggaattcatcgtaggctgcctcgtgatatttccgtaaaatatcgcgaactaccacgatagccttatcaattgcaggatcttgaatataataatcttcaattggcatcaattgatgactgttcttcttgtaaaaaccagtcgttagttgtccttggacttgtcgtacgggtacttgggccttgttccgatactgcgtcgggttggccataccaatcgttggtaaaacttcgacatcatccatgtggacctttgcaaataattcggccacctggtgctgtttaaacttcaattgttcactgtattccaagtgttgtagtggtgcaatcccggtttgacgataaacgcgccctttaggattaacccgatgaggactcacttggttaatcttttccacatcaccaaacgcaaagttcttcgtcgtcttcgtgaccttgaccgtaattttttcttctggcaatgcattttcgataaagattgggtaattatcgactttagcaacacccataccctgataggttaaatccatgatagtgacgtctaaaacttcacccttgtgcactggtaaattaactttcatttgtttcctcttgctttctttgttagtgacttattaatttttagttactgcctggtagccactgctccgggcagcgagtgatatggtcattaatactgccacacttggcagtgtcgttaacatttactgattaaacatgctattcaaattgcttaccatgagtgtcaaaacgcgcgaatttgagctgtctcatgctttgcaccactgacaaatcattgctaaaccgacaaacgattaaatcgtcaggcaatgctcaatcatgtccctgtgacggtaacacttttaaaaaaattaccgtccaccattgtatcggtaaacggtaatttaagcaagttattctgttttttcgtcgtcctcagttgcagctggcaactgatcaacggctgagacaaagtgtcgctcagcgtcttccaactctggatccgtatccgtgattgcctcatcggggatccgatccgtatcggcaaacatttcgatatgttgctttaaattccggaacgtcatcggtgcatcaccaccgtactccccatccaaattgatcattaagcgatccttgtcagccggtttggcgacgaccttgctcgtcttcacataaataatgcttggatcattgatatgcttgccaccattgagcactaatgtcattaagtgaagcattttggcaaggttgctcgtcttcacaataatcatggtaaatttaccatcatctaatgacgcgtccggcactaactgctcaaagccaccaactgaattagtcagcgctaagaaaaacatcgaagccttgccctgataatgaccaccatcatatttcaaatccatctcaactggttttactcgtggtaataactcagcacccttggctaagtatgccgcgtacccaaaaatcgacttcaattgtgatggtacgtcataggtcagctccgttaacatgcccccagccgcaatgttaatgaaatactgttcaccagcctgaccgatatccatcttaaccgtctggttctttaggactaccttggccgccgcaaccggatcattgcgcggaatccgcagtgcccgggcataatcgttggtcgtacccgccggaataatagccatcttaggtcgccgctttaacccggctaacccgtttactacttgattgatggtcccatcaccaccagctgctacaatcagttcaaacccgtccttggcacaacgtcgcgcttcatcagccgccgaattaggggcgggcgtcgttgcgaacgcactggtctcataaccagcttgttcaaagataccaagaatttcaactaaatcgtgggccaatgcctcacgtccagaagtcgggttataaataagtcgtgcccgtttacgcatgtttcctattcctccgctcacacggtcaagcgttcagcgtctcatctctaccccaacgctggacatgcatcaatcgaggctcaacaccttatcgaccaacgcttctaccgtgcttttaatgatgtcattaatagttggttgacgactttcgggttagcttgaccacgtgtcttcttcatgatttgacccacgaggaacccaacggcccggtctttcccgttcttaaagtcatcaattgattgttgattattatccaatacgtcgtcaacgattggttgtaacttcgccggatcagacaattggactaagcccttgtcgttgacccattggacaggttctgagcccgccataatggccttaaagaccttcttagcaatcttacttgagatggtttcatctgaaatcatcttgatcatcccagctaagttagttggcgttaagtcagtcgctaacaaatcaactttatgctcgttcaagtacgcgttaacgtccccttgcaagtagtttgaagctaatttaggatccgcaccttcagcaacggttgcatcaaagaagtcagacatttccttagtttgggtcaacacacccgcatcataagcagttaaaccaaattcattgatgtaacgttcacgccgcgaaccaggcatttctggaatggtcttcttaacggatgcaatccagtcatcatcgatatcgactgctggaatatcaggttctgggaagtaacggtaatcatcgctaccttccttgacccgcatcaagatcgtttggcccgttgtttcatcaaaacgccgcgtttcttgttggatcttgccacccgccatgagaacttgttgttggcgttgctcttcatattctaacgacttgcgcacgtagttgaaggagttcaagttcttcatttcggtcttcacaccatacttgtcggaaccggccggccgaattgaaatgttaacatcgacccgcattgaaccttcttccatcttaacgtccgaaacgcccgtaaattggatccgttgccgcaacgcttcacagtaagcataagcttcttctggggaggcaatgtcaggcttagaaacaatttcaattagcggcgtcccttgccggttcaaatcgacataggaatagtcgttttcatgggtgtttttcccggcatcttcttcaatatgcatctcttcgataccgatttttttctttttaccatcaacttcgatttcaatccaaccatcatgcgcaattggtttttcatgttgcgtaatttggtaggccttcgggttatccgggtaaaaatagttcttccggtcaaagtacgtgtgatgttcgatttcagcatgtaaagccgttgctgctttaatcccagcttcgaccacgcccttgttaggcgttggcaatacccccggatacccccagtcgatcacgttcgtgttggcatttggttcggaaccaaattgcacgggtgaaggactaaagatttttgagttcgtttttaattcaacgtggacttccaaaccaatcgtggttacaaaattcattagttagcacctccgactttcggggtttgcttgtaaacttgcgttgcttgttcaaaggcatagcccgctcgatacattgtgctttcatcaaacgccttaccaattaattgcaagccaactggtaacccgtctgcaaacccagctggtactgacattcctggtaacccagccaagttgactggaatcgtcaagacatcgttcatatacatcgtaattggatcagataattcgtcacccaacttaaaggccggtgttggtgcaactggtcccataatcaaatcgtaatcttcaaagaccttattaaagtcattgataatcatcgtccgaacttgaccagctttgtggaagtacgcatcgtaataaccagctgacaaggagaaggtccctaacataatccggcgcttaacttcatcaccaaagccctcggaacgactacggacatagacatcttccaaattcttaacatcgtcagcccggaaaccgtaacgaatcccgtcaaaccgttgtaagtttgaagaagcttctgaagacgcaatgatgtaataagcagccacaccgtagcgactgtttggtaaggagacttcttcaaccgtagcacctaagtcttcaaactgcttgactgcttgttgaatgacttcacgaactttaggatcgatcccgtcgcccatgtattcttttggtaacccgatcttcatacccttgatatcacccgtcaaaccggccgtaaagtctggtacagtttgtttggatgacgtggtatcatgcacatcgttacctgcaatcatattcaaagcggccgcgttatccttgaccgtccgtgtcattgggccaatttgatctaatgaagatccaaaggcaatcagcccccagcgtgagacccgaccgtacgttggtttcataccgacaattccgttaaatgatgatggttgccgaatcgaaccacccgtatcagaaccgaatgcaactggcacttgtccagaagccactgcgacagctgagccacctgaagacccaccgggcacccggctgatgtcccaaggattacgagtgacatggaacgccgacgtttcagttgaccctcccatggcaaattcatccatgttggtcttaccaacgatcaacgcgttgcttgctaatagtttgtcaaccaccgtggcattatagaccggcacgaagttttccaacattttagaagccgccgtcgtcgttaggcccttcgtcacaatattatccttgactgccatcggaatcccagcaaaaacgttgttcgcgtcgatgccattctgatccaaagcagctgcctgttgtaaggcatgttcttcatttaaattcaagaacgcccctagcttagggtcaacctgattcatattcgcaaaagtggccttcgctagttccgtggcactgatcttcttggctaccaagtcagcgtgtagactagttagatcttggtcgaaataagtcattattcaccgtccccactttcatcaataattgctggcactttgatcaagccattggccgtttctggggcattcttcagcaatgcttcccggagtgcttcatcactcttaactgccacgtcttcacgtagcgtattcgtatgatcactcatccgtgacgtaacgggtacacccgtggtatcaactgtgcttaattcttcgaacatgccgataattttttctagttgcggtgtgaacatcgctaattggtctggtgtaaactccaatttggctaagctcgccacgtgttgcacttgttcggcattaattcgttcttcagccatcagatttccttctttctcaaatcttactcaatattattgtttaatcgtcgccctggtcactaaagacatgggtgtaatacgaactacccttcgccgttctggctaagaagctttgaatgtcaccattggcactcttaaccgtaatttcaaccggtacaccagatggcaagtaccgtttagcagccgttgctaagtactgcgtgaaactgatgatttccgtttcgctgtagaacttagtcgtgatgttgacacttaatttactcaacgatttgtccttgtaatgagcattcgccgttacgccagacaagttcgggaagaaattctgcacgtgggacttaaactgactaaagtccgactcatcattactattcgcacctgagttctttgactcagaggtcgctgggaagacataattcttccaattcaacgacgtccagtttgagatcgaagtggagccgttcttagaaaccgcgtaggcaatcatgtcgcccccaactaaactatcattcgaagactgcttatagagtgccaagacaatcggcacattcttcaaagctgagcgttgccgcaaccgctgtaagacagtattcgccatcttcttaccttgcgccgttaactcagtcgttgagatgtccgtttcgtatgttgccccatattcgaccttagtataataatcgaccgagttcattcccaagccaatcgtgaccccgccaagcgataacttactaccattttgaaccatataatcttgttcttcaagctgttgtaagtaaatcggattccgagtattcggatccttcttaccgttattctctgggttcaagccctccgaattgctgcttgatttccgtccgagccaattttcaactgtcgatgagctcaaatactgcccttcttgaaagacatacttactcgttggaaagacctttttagacacgtccaataagccactttcgaagctcttcaaattcatgacgttatcattttgcgaaacgaccacgcctcgcgacttactcgtccgataacggccatttttgatgacgccttgatagaactcactatcagcagttccagtggtggtcgttgttttcgttccggtcgttgtggtgctactactagtcgacccaaaggacgaattctttaaattaccgcaggcggctagaacaatggcagctactgccactaagccaatcgtgcgtatgcgtttaacattcacgcttgtgcatcctccctcattgtttcgctgaaccgggcttcatcccatacagtaatgtccagctgctgtgctttttgcaacttgcttccggcatcgctacctgcaatcacgagatccgtctttttagagacgcttcccgtaaccgtggcgccgtgagcttgtagccattgagtcgcatctggcctcgtaaagctttccagcttaccagttaacacgacccgcttgcctgcaaaccaactgttactatcttctgccacggtggcactagggccttgataagtggtattcacgttgactgcttgcaattcgcggatgagtgtatgaacttcgtcgctctcaaaatattgaaccactgcgttcgcaatcacatcgcccatcgaatcgatcgccgcaatctcttcttggctagctgccatcaacgcctcaatcgtcccaaaatgctgcgcgattaaccgcgccactttagcaccaacgtgccgaataccaagaccgaacaataaccgttcaagtgaattatcacggctacggtcaattgctgtcaagagcttttcagcagatttatcttttattttatctaatgttaacagttgtgccttagttaatcggtacaaaccagcaacgtcactaaccagccgatttgcatagagttgcgcaatgattcgtggtcccaagccatcgatattcatggcattgcgagaggcaaaatgaaccagcccttcttggacttgtgctggacatttcgggttaatacaccgtaaagccacttcgtcttccaaatgaaccagcggcgccccacaagacggacacgtggttggaataactaatggttgcgcatccttgggtcgtttggctaaatcaaccgatgaaatttccggaataatatcgccagccttgtgtagcaagaccgtatcaccgatgcggacatctttggccgccacgtaatcgggattgtgtaacgaagcccgcgcaaccgtcgtcccagctagttgaacgggttccataaccgcagttggcgtaacgactcctgtacggccaacggtccattcaacatcctttaaaagggtcggctgctcatcaggtggaaacttaaaggcaatcgcccatcgtggcaccttgactgtcgctcctagtgagcgttgcagcggtaacgggttagctttgatcacgatgccatcaatgccatatgctaattctggccgttcattttgataatggtcaatgtaactaaagacatcggccatcgaatgggccaccttaaagtcaggattgatggcaaaaccaagatctgcgaactccgttaacatgtcactctgcgtacgggcggttaacggttcgtagtcggcaatgttatacataaacgtgctgagctgtcgttccgccacgactcgtgaatctaactgccgtaacgtaccggccgcagcattgcgtggattcgcaaagactggttctcccgctgcttctcggcgttcattcaaggcagcaaacgctgccttaggcatataacattccccacgtacatcgatcgtcagtggtcgggtcaaccgttgtggaatcgacttgattgtcttaatattagccgtaatatcttcgccaaccgtaccgttaccccgcgtggacccttgaacgagcaccccatcttcgtaacgtaacgacagcgctaaaccatcaattttcaactcacaattataatcgactggatgaccaacgttttgttccaagcgatcaacaaactcttgtaactcagcttgtgaaaagacgtcgcccaatgacaacatcggaatctcatgggtcactttatcaaagcctgctttaaccgttccaccaactaattgcgtcggtgaatccggtgtaacgagctgtggaaaagtttgttcgagttcgaccaaccgttcatacttttgatcatacacactatcttcaacgttcggcgcatcttcgtcatagtactgccgacgccattcatttaacgtttgccgtaaagcagccgcttcatcagccgcctgctcaaccgtcattgtgttgggtttgtccgccatcagccagtcctcctaactagtcctgtactttttggatcggtgcaaatgcggctaataaccgcttgattccttcagatttgaaagcaatgtctagttcagcatcttcaccagcaccggagaccttcacgaccgttccggttccccacttacgatgcttgactttatcaccgatcgaccaactattcttgtcagcacccgtgccactagccttcttgaccgtggcccgcgtccccactggattctttttatatgaaggtgtaaaagcacgccgttcacgatccgcaccaaatggaactttaggaccagtgctacttgcaccatccaacgtattttcatttttgagtaattctggttcgatttcttcaacgaaacgggaagccggattattctgccgccgaccgtaaagcatccgtgagtatgcattggtcaagtacagcttcttctcagcccgcgtaatcccaacgtatgctaaccgccgttcttcttccagctcgtcttcatccatcattgcccgggacagtgggaagataccttcttccatcccaatcaagaaaacaaccggaaattctagccccttcgctgcatgtaacgtcatcagcgtcacggcttggggttcttcctcaacgttatccacatccgaaaccagtgctaaatccgctaagaagtccacgaatttgtcactatcttcatcttcaggttgataactatcatcgaattgtttggtgacagacaagaattcttcaatgttttcgatacgggcttgtgcctctaacgatttcgttgccttagcatctttcaacgccttcatgtaacccgtgcggtcaagaatctcttgtgttaaatccgtcacggataagtattcccgcatagcgcgcaattcattcatcgtcgctgcaaacttcgctaaagcacccttcgctcgtgctgaaatgccattagccatatcaacattgctagctgcttccaacatggaataacccgcttcatccgcgaacaaccgcaatttttcaacactcgtttgaccaatgccgcgcttaggttcattaacgacccgttcaaagttcattgaatcttgatcgttcactgccaaagtcaagtaggataagacgtcccgaatttctttacggtcatagaacttattaccaccgaccattgtataggggatgttcgccttaacgagtgactcttccattacccgggattgtgcgttcgtccgataaaggatcgcaaaatcgccgtagtccattttgtcctgctgcatgctttcttgaatcttggcaatgacaaagtgagtttcatcactttcactctgaccacgataataagaaatcttgtcacccggttcattctcagtccataatttcttcggccgccgcgttgaattattgttaataactgcattagccgccgacaaaattgtcttggtcgaacgatagttttgctccaacatcaccgtgtcagcttgcggataatccttttcgaaatcgagaatattttccatgttggcaccccgccaaccatagatggattgatccgcatccccaactacacacaaatttttatatttgtcagctaacaagttgactaacgtatactgtgcgttattagtatcttgatattcatccacgtgaatataatggaatttgttttggtaccacgccagcgtttctggattctgcttgaataattgaatcgtcagcatgatcagatcatcaaagtcaacggcttgatcagccgctaattcacgttggtattgcaaataaacgtctgccacgacactctcaaagggactggcagccgattctttatacatctccggcgtttgtaagtcatttttcgcatttgaaattgcggataagattgaccgtggatcaaattttttcgaatcgatattttgttccgtcaagattcgtttgactaaggtccgttgctcgctagtgccggcgattgtgaacgctcggttatacccgatttgttcaatgtcacgtcgtaaaattcggacacacagggcatggaacgttgagacccagacctcctgcgccgattcacctaacagcttaccaacccgttcacgcatttcgcgtgcggccttgttcgtaaacgtaatcgctaaaacattccaggggttgaccccttgctcttcaattaaataagctacccggtgcgtcaatacacgggtcttccccgagcccgcaccggccataattagtagcggtccttctgtgtctaaaacggcttcttgctgcttgtcattcattcctgccaataggctttctttcgacacgctgttcgccaccctttctaaaaatcagtcaccaaacattatagcaaattttggccgtgattgctgtactttaaggtcagcatctcatacaaaaatcgcggtttttccattgtcagtgacacctatgttaattttacaacttctactattcacgggaaacgaattgacggcaatattgcgtaactttaagtaatttcgagactccctcaatttctaaccaaaatacccgccacgccaatctcaacgattccccctcagataaccgtatctcgccatttggctggcttctccccaaccgctaaaaaaatccaattcacaaaatgaattggatttcgaactttatttattcacgacggttacccataatagctggtcacccggtgcgaacagtacgattagtttaaccgtaataatccgtaaaactaggttctgatcatacactactcagcttcaggttcattatcagccggcgtcgtttgcccaaactgccaaatacttgtgtcttcgatctgttcgagtgcttctttaacacttggtgcttcgactagcacgtggccagcgactggtgcccggtgcgcttgtaacaacgttcggtgatagaaattaaagaaccagttcgtcttaatctgccactgcgtgcgaatgccactctcctgagccggtgtaaagtaagcagcaaccacgggcatcaactgcttgactggcattaacggcagtcccgcaattgctcgcaagtgttgttctgccatactaatattcgtagcacgttcgaagacataacccgcctgatgcatcgcagggacaatccgcttcacgtataaattaccactcttcgttaagaagaaggcaacttcaaagacacccgtataactcaagttatcactaatttcctttgtgatccgcagcatttcgtcattcacagctgaatcaatttgagctggcacaatcgaggcaactagctcatgattacgataccggttttcaacggttgggaagaaagctgtcgtatcaccactcttagcgccaaaaacggagagttccttatcatatggaatcaatgactctaacaagtatgtgccccaatccaacagatcagccgccttgacaatatccgtctgcgtcttaatgaccagttgccgattttgacccaagcccttttgaatcggcttcaaaatactaggatatccaattgacccgatcgattgatagacatcatccaaactgacaattgtcgctgacggtgctacattcaagttaagttggctgaaaaacgcccgttccaaagagcggtcctgtgtaatctcaagcgcatcggcgccttgtggaacccgggtatgggccgccaaaaaattaatgaccgacgcatcaatggtttccgactcgtaagtcaccatatcacaacgttctgcgaagttctgtaactgttgttgatcattgagggccccgacaacgcgaaaatctgccagttccatggtctcagtattttcgttatcgccgtataccccgacattgatgccagcattacgcgcggcaattactaatccaacaccattagtactacttccaataatgccaagcgtaccacctgggtttaaaatcgagttgtccacttcagtccctactttcctatgctttaaataattataatctgattattgaattattttaacgctcattatcctgtaacaatcatacttgctgacacgcacagttgcaagtttatcactgcttttttcggcgagcattgcgtcgcttaactcgcttgagccaaaagccaccggagatgtagcgtggttcatacgcgatcacaaacgcattgggcgccgcgtctttaatcaggccatacagccgccgttcgttcttccgtggggccaaaatttctagttctagccgctcaccttctagaccataagcagcgtgttgtgtgaccccaaagccattttcacggagcactcccggtaacgacgacttgggatcaggtaaaatgactgaaatcattgtataccctaacgctaatcgatcttcaattaccatcccaacatacaccccgacaccgtaacctaacgcgtatacgactaaattaatcggattattgagacgacttaagaccaatgataatcctagcacataaatcgtaatctcaatgacacttgcaaaagctgcaaaataccgataaccccgcattacaagcaaaaaacgtacggtgtttaacgtaatgtaagcaaagttgatgatgaaaataaggactagcatccccatgtcaatgtgcatcacaatcccccgctttcttaacttaagcctgggtgtcctccgatgcaaagtgcacccggtcaccatcaaatgacgtaatctgtgctagtgattctaaacggacaccccgatcagcaatcagttgatgacccgtttggaagactttttcaatcacaataccgacacccgcaatttttacgtgcgctttatcacagatttcaaacatcccttgaaccgcctgaccattggccaaaaagtcgtcaattaacaagacttggtcatccgcctgtaagaacttcttggcaatcgagatgtggttagacgtcttcttcgtgtaagaataaacttcggctgtatataaatcatcaattaacgtgactgatttgtgcttacgtgcgaacacaacgggcacgtgcattgctaaccccgccatgactgccggcgcaattcctgatgattcaaccgtcaagattttcgttacacccgcatcttgaaacaagtgggcaaattccgttcccatggcaaacatcaggtcgggatcaacttggtgattcaaaaagccgtccactttcaatacttcaccgggaagtacccggccatctttcaaaatgcgttcttcaagttctcgcatagtaccctcctagaattataagcgacattgaaatactgctattaatttcattactttctatcataccgttgtaagtcatatttttgaataatattaattaatttttgtgcataacttggatcagtcgcatatccagccgtctgcaatgcttgcgcagctgtctgataatcagttgccttaatcaccgcagcgtagtgctgagaatcccaagtcgttccgtacgccaatttcttggcatgatcgaccagcgaagcgtgccagctatcataaacggcgaagcgccgtttgaccgtatgataggccccgtcataatactcctgcgtcgtcatgagccgtcccgacgtggacttaaccccaaataaattattgttctctgtcgcattggtactttgtccccaatccgattccaaaatcgcctgacttagcgtgatactagccagcacgtggtattgctgatcaagctgttgcgcagctggtactagctttttaataaatgccgcatgcgttgttgtaggtgctgtcgccgtaacccgcgacttaaccgcccaattatgctgaatataccaaaccatccccaccatcgccgccaacactaataagatattgacccactgaaggcggcccttcttcacaaataattgtgtctttgtccgttgcttccggcgcgattttcgccgcttacccgccatcatagccgcctcctttctggtaattaccttacagattacacctgttcatttatcatgaattaggattaaaacatgctggtttcttagttcaaaagctgccagcttaggccaactgtaaaaagtgcgagttagtgtaaacgtgtttagattaagactcgtatttgagatgacgcgggttgggcgttagctcaaatcgacatcggctgcgttccagtaattgtcacccggccccgaaagtcggcataagacgcgcacgtgctgacgaataagaatccaactaaccaacatgttttaattctaagtaagcctaaatcgcaatgagcatcggtcatattacactctattttaccgacttttgaattaattttacatgattattgggcgccaattccttatttttttgctaaaatgtaagtggtcacattcgattaatcctaggaggaagctataatgtcgaaaacttatcgctgggccattgttggccttggtaacatcgcgcacagtttcgttaaatattttgatcaacctgacggagaaatctacgccgtttgctcacgttcgcaggaaaaagctaacgcctttgctgccgaacacaacattcccaaagcttatggtaatttagacgagctactggctgatgaacaagtcgacatcgtttacgtggcaacgccccataattatcacattgacacgattttacccgccttacgtgctggcaaacacgtcctcagtgaaaaggccatcacaatgtctagtacccaactcgcaatcgccaaggaagtggctgctagcaaccaccttatcttagcggaagcgatgaccctgtatcacatgccattatacgagaagctccatgattttgcggcagaacgtcatcttggtgatctgaaaatgatccaagctagctttggtagttttaaagaaccagacccaactaatcgcttctttaatcccgaccttgccggcggtgctttactggacattggtgtctatgccctagccttcgtggaagaattcttgactgctaaaccatacattaccggaacaaccatgcaccgattcagcagtggcgtcgatgaatcttcgacaatcacgttacgaaacgccaatgatgaactggccaccgttgccttaacgttccgagctaaaatgcctaaacgcggtatcgtcgcgtatgagaatggttactttaccgttgatacctatccacgtgccgacagtgccactttcaccgacagcgaaggccatactgaaaccatcacagccggcgatagcactaacgccatgaattacgaaattgctgacatgcaaaaaatggttgctggcgaattacacaacacgagtcttgctaaaacgactgacgttatggatatcatgactgccgctcgtgcacaatgggacttccgctatccatttgaaaactagttataaataacatctttatgtaaattaaaaaagcttagataccgtgtgttttttcacacgatatctaagctttttttacccccgtgaaataccattgaaaaaccctaagccataaaatcagaaagccagcttggactcgctgggaaaaatactgcttagtatcaacttggttagttggcgctttctcaaaaccatactcgtttaattgaaggactagttaaaaatcagtcctaagcccatgaaaacgataaatgaaagacaaatcaacgttgcgtttttaattgaaatcgtgaaagtttctcgtttgacctgtttgtgcaagaagacccgcgtatttttccaaactgaaataatactgagcaacgttagtaaactaaactttggcagcacacccatcaagaccgcgatcaccagacaagcataaccagcaacgtaactccatgcaaatacctgaagcatcaccggtttgccaagataatacaaaatcgtgtgtcggcctaacgcaatgtcttcgtccatatcacaaatattattagctaacataatgttagaaattgcaaaaatggccagacctgacgcaattaaaacagccagcgttgactgccaagtaatggctgccgtgtcatacgtattaataaagacggcaatccagaagatcataaagcccatcgtaaagcccgagaaaaattcgccaaacggaccttgtgaaattggcttcggaccgccagcgtaaaagtaaccgaccgcatatgaatatagccccatccacaacaacggcaacccggtttgtgttactaaccatagtccgataatcaatgagattccggctaaaccaaacgtaatcgtccgggcctggccaatggaaatctggttaacaccgaccacattagtctcttgcaaaaattcttgattgtcgtcattacgtggcgcgtgtaggaagtcttggtaattatcattcgcattagtcgccatatgaaaaagtgaagatgcaatgaaaaatagcaataaataaccaagatgtaactgatgataattataataggcgtacatactccccaaaacgaacggtaacacgctcgcaattaatgatttaatttcaacaaattcaagaaacacttttggtttcaatgatttacaccatccttttgtttgacaacgaaacaagttatttgtacctttaatatagattgtattttagaatgtgactggctgcaagtgttggcgtcaaaacgtcccggagccatctctcaaataaagcggggtattttgattatgatgcaaaccatttggcaaccggaaagtcttgtcgcaaaggagctagcagcgctgaagccgtatctagctactaacgtaaaaattgataacgccgccattaatgaccgcgtacacgacttactcgctgcgggtggtaagtttttacgcccgggcttcttttacttgtttagtcaatttggaccggatcataacacggcccggttacgtgctggcgcagcggctatggaactactacacgtggcgacactgattcacgatgatgtaattgatgaatcgccagaacgccgccatgtgacaacgatccaccaagactacggtcaacgtaatgctatttacgccggtgatctgctgtttacctgctatttcgatcaagtcctgattgctgccaagacagctgacgacgttaaaatcaatactgcggcgatgcgagccatcctccaaggcgaactggatcaaatggcacataacttcgatccgacgaccacggtcgatgactacttagcaattgctcgtggcaaaacggcccgtctgttcagcctcagttgtgaacaaggtgcccacttcgcgggtgccgacgcaagcgtcgttaaactagcgcaacagattggtgaaaggatggggttagcctaccagatgttagatgacgtccttgactacgccggtgatgaggccttaactcaaaagccggtgcttaatgacttacgggacggcgtttattcactgccacttatctacgccctgaccgctgaaccacaattggccgaacaattaccccaacccggcgaccacatcagtaatgaacagctactgacaattcgcgatcaggtcattgctttggggggcgttacccaggcacaacaattggctactcactataccaaaaccgcactgaacctaatcgatcagctaccaactggtgaaacacaacaaactttacgccggctagtgactgaattactggttcgcaaccattaatacacaaattaaatcagcgcgtcaaagtaacctattactctgacgcgctgatttttcagctacaaccattactcaccctacaccgccgcgatttagtcaaaattgttatccattccgccgagataaatagtattatagtgtttgtataaaaattgtaataacggggctatttttactaggaggggtttcatgaaaaagattgttaattggttgctggggagcgtactaatgatcgcagcggtcacaatgctaagttcagtatctgcgaatgccagcacttactatcatcgcacgccaacgcgggcaacggctagaaaggcttattatacgaccgataccaaatcacatacctttagggctaatggtaattataatcgttggacattcagggccaatcatgatttgaagaactatcgcaacaccgtctggacaacgactcagcaaactgatattatcatgcacggcaaaaaggttcgttactactgggttcacaatagcaagaatggggccactggctggatttggagtggctacttaaagccagttaaagccaaagctgccaccccatccgaagcaacactcgtctccagaatgcgcgtgtccaaaaaggctcagcaaatcgtgacggtcattcaaaatggctcatccacggccactcttaaactttggcaaaaaaccaatcgcggctggaagaatacactaacttccgcaagtcgcatcggggccgctggcatcggcaattctcacgaaggcagcagtaccacacccaaaggcgtttatcacttaagcttcgcatttggtaaagctgccagtgcaagaactagtggtatggcctatcgacagatcaaccggaaatcttactggattgaagatccacatgaccggcaatataacacttggcagaaccgaaactgggccaataataagaacgagcatctgatcgattacacgaaggccgcgccccacaatcagtatcaattagcgattgtgatggacaatcacggtcagcataatggctcgggcttctttattcacgtcaagaatcaatgggcaacggctggttgcgtctcaatcaattacaatgatgtacggaccttactcagccgcttaggcacgaaagcctacgtggtcgacgttcagaatcgggcacaattacaaaattactaacaggttaaatcataacctggcgattaattgcatataaaaaggacttggtcacagcgaccaagtcctttttacgctctaaatcggcggtgtaatcagtaatggtcatcatgaccactacattcgtaggctgaatacccattcagcgcagtaattaaaagtctgtttcacaagcccaaggtgcacgtgaagactgctatcaaccggattaccgatcattgttcgcatcatcacgcccttgatccaaatcataaaggcgtttaaaccgcggtgcgttcgcatacaattcgctcggcgtaccggccatatcgaattgaccatcttccaagaagcgaacttggtcgacatggttgaccccggccaaatggtgcgtgacccacagaatcgtcttatcatgcaagacccggaacaccgtggtcagcaaatgggcctcggtaatcggatcaagactaactgtcggttcatctaaaatgatgatgggcgcatcttgtaataagatgcgggctagcgcgagccgttgtcgttcgccaccagaaaagcgcgcaccgccctcttctacaactgtctcgtaaccatcggggagcgtgtcgatcaagggcgctaactcgactgctgctagtgcggctttaacttgttcgtcagtcgcttgcaagttacccatccgcacattgttcataatcgtggtattgaacaagtacggctgctgatccaagacgccgaataactgggcgcgctcattttgtaaccgtgtgatgggcacatcattcaattgaaccgtcccactatccggtgtcaggtcacctaaaatcagcttgagcaaggtactctttcccgttccggaaggtcctagcagggctaacttttcaccggcttttaaagtcagattcaaaccgtcaaaaatcgcgtgaccaccttccgcatatttaaagtcaaggtccgcaatacgcaatacttgaaatggctccgttaagactgtctgatcgtgttcatcttcaggcgtggtgtctaaggcgttgactcgtttgattgaccgttgataacttggccactcactaacaccctgactaacagactgcatggcatcgaccaacgggaatacggagaggacaaacgccgcaatccaattggaactagccgcattcgttgtccagtaaaaactactccagatcaagagcgccaaacaaatcaccccgaaaatgatctgaatcgtaaaatctcgccaccactgaaagcgatggtcctgtttacgaagtgccgcaattgcttcgataggctgggtttgccgctcatagaaatccgtttgacgtccggcaatcaaccaatcaccgagccccattaccgaatcagtcagctgcgtataaaagccctgttgaatctgacgactgcgtgattcacgagcaccattcagtaagaccgaccatagcggcattaccacaacgaccaatcctaacatcaacaacatcaatagcccgaaccaccagctaaagtagcccagaccaatcacaatcactagcgtcatcaaccaggcaatcaccgttggaaaaacggtccgtaaatataaattttcaatatggtcaatatcgtcagctaaaatgctcaggacatcaccagtctggaaattttggcgaatcgctacggcgtgcttggcgacggattggtacagtttcttacgaaaatctgacacgatccgtagcacccagttatgactcgtaattcgctccgcatagcgaaaggcaggccgaccaatcccaaacgctctcgttagaacgattggcacataaatcatcagaatattatacgggtgtcgtgcggctttactgatcaagtagcccgagttgaacatcagcgctgaaccgcagaaaaatgtcattaggcccaaaaacagcgtcagggctagtaactttttatacttgcgcaaatacggcatgacccaagtatcatttttaaaagttgccaaaaaatctttcattagatcgcacctaccatttcatcacgtaaccgaacgtacgccccgtcatgcgcggccaattccgtcggtgtcccttgttcaacgatttccccatgatccatcactaacacgtaatccatctgattaatccagtgtaaccggtgagtcgcaaagaaaactaagtgattatcaagtacgggtaaaatcgtcgttttcagttccgcttcagtttcaatatccaagtgggcagttggttcatcaaataacagaactcgccgcgagtcgtcaagaaaggcccgcgccaaagcaatccgttgcgcctgaccaccactgacaccacgggagccttcaccaatcgccgtatccaaccccgctggtaacgttgcaatccaggccgttaatccagcgttttcagcagctcgttcaatcgcttgacgtgaagcgtctggctgataaaaagcgatgttctctgctaacgttgcatggaacagatatgggttttgcggaatgtagaaaaagctctgctgccaggcgtcctggctcaaatgcgagactgtttgcccgttgacttgaattttaccctgatcagcgaccggggttagaaagccacctaacaaattgataaaagttgatttgccggagccggatgccccaataatcccgatccgttggtaaccatgcacatcaatattaatgtgttttaaggccagctgatcatcatcatacttaaaatcaacgtcatgtaagcttaacgtactatcactttgccattgcacaggctgagtaccgagctgttgacgttcagttggcaccggcaaagctagcatcttctggacatccgcaaacgcattcttgccatttaaagtggcatgataatcattagcaaatgttcgtaatggcaagaaatagtctggcgataagaccaaaataaccaacgctggtagcaacgtaatcgtgccgttaatcaaaccaaaaccaaggaagaccgcgacaaccgcaatcgataaggtcgtgaagaaatccaaggcgaaagtcgataacatcgcaatcttgatgaccgccatcgtttgcttacgataaccttcactaacctgataaacgttgtcagcgtaccgtttgctcagtcctaactgcttcaaggtcggtaaaccgcgcagtgtatcaacgaagtgattagacatccgttgatagcccacgtactgcttatccgctttagcttgagcggcatagcccaaaataatcataaatagaataattaatggaaaaattgccagtagaaaaagggcctcacgccaacgcaaccacgcgatgtaaattaaaatgatccacgggatcaccatcatgtcgattactttaatcacaaccaacattaagtatgtctgaactttatcgatgccttcaagcgctgtcgtcaccacgttaccagtcccagtcttagccacataacttgggccgagccggtataacttctgcatcactttacgccgcaggtcacccgtcgtctgttcgactaacggatacatcacacgatttttaatgacgaccagtaactgccgtccgacccaagctaatgcgaaccatagcatgggctgactgatcgacgccaatgaatgcaagtgccacagtccaacaatcgccactgatagatagtaggcctgaaagacaatacaaataccctcgacgatggccagtaaccctaaaatcgtggctgctcggcgcatccctggtagtttaaataatgccggatcaaacacattcgatcactccctacttaaaatgaacggggtcgcaccctggcacttggccaaggtcgcgaccccgttggtgctgttaaattaattgtaccaccgcaccagtgatactgtcgtcatctgcatttgaattacgatgccaaccgtttatagaagacccagtaactccaaataaagtagatcaacataatcggtaataccgataatgagattacagtcatcagatgcaacgtatatggtgaattagacgcatctttaatcagaatgctgtatgcagaattgttcgccaccatgacacgtgggaatagtccattgaacaggagcacgaccacgtcgatcagtgagagaccactgctaataaatgagagccattcatgatttccataaacaccccaagttgccaagaccgtcaaagccactaaggcgaccactaaaatcgtggttgagattggtttcttggtaaagaaatcggtgttaaagaacagcagaattgcgaagacaacttcaccggcaaacaggacccagtataacggtttggcccactgaagcgcccgttcacgcaacgtcccggtcgtcttcagacgaataaagtttaacccgtgcaaatagcagagtaacgttacggcaaccccaccaacgattgagaacaagttcacgtaatcggtgaagtgggcagtcatatcgccattggcattgattggcatccctttgaccaaagcagtaaacatcatcccaaataggaaggcagcaaagaaactacctagggctgcggcccattcccagaaattccggccggcgtcactttccatccggcttctaaattcaaatgagacccctcgcataatgagggccactagaatcaacaataagataagatagaatccggagaataaggaagcataccacattgggaacgacgcaaacatcgccccaccagcagtgatcaaccacacttcattggcatcccaatgtgggccaatcgtatgaatcacaacatcgcgctcagcgcgtgtttgggctaagctcttaatcgtcatcccaaccccgaagtcaaaaccttcaaggaagaagaaaccactaaatagaacgcccaccagaataaaccataagaattgtagattactcatgactgaacgcctccttaccataaggatcgtacggtgcgtcatcgctagcttgtaacaaatcatcaggtccttggtgtaaggcacgccgtgataagacgatcatgacaatgcctaagccactgaacaagcagaagtacacgatgttagagatcagcaacgaagcgacactaacatttggtgaaacggcatctgcaatcgtcagtaaaccataaacaacccatggataacgacctaattcagtaatcagccacccggccgtgtttgcggcgaatggtaagaacgtacagattcctagtacccacaggaaccagcgctgccgctcaatcagcgttgactttgcacggttgaagtatagaccgataatggcaatcagtgcgaagagcccaccagctaccgtcatgacccggaagctccagaaaagcgtctttgttggcacgtagtagttcatgtccttaccaaatttcttgtcatacttggcatgaagttccttgttaagggtattttgtcccttcacattaccggacaacttatgatagcttaaaatatccaacacatacgggatttcaatcgaccagttggccttatggttcttagtatccatcccttcaataactgcccatgaagctggcgagccggaatccttatataagccttccgttgcggcaaacttcatcggttgttctttaatgatgtaacgcgtctgtaaatctcccattccaatcacaccgatggaagcaaccaggccaacgattaaactgaccttgatcgatttgcggaagaacgtgacgtttttctttttgagtaacgcaaacgccgccatcccagcaaccacaaatgagccggtaacaaacgccccaaacaacacatgtggtaattcataccagagctgttcgttcttgacgactgctgcaaagctcgtcatctgtgcacgaccagtcttggtattgatcatgaaaccaactggattttgcatgaaactgttcgctgctaaaatccacatcgcggaaatcatcgtcccaatcgacgttagccagataaacgcacagtggagcttggcattaaaccgatcccaaccaaacatccataacccaataaacgtggattccataaagaaggcaactaacgcttcaatcgctagtggcgccccaaaaatgtcacccataaaccgtgaataatcagaccagttcatcccaaattggaattcttgtataatccctgtcacgacaccaacggcaaagctaagtaagaaaatgcggccccaaaattgtgccatgtgcttgtacatgatgtcttttttgacaacatacaccgtttccatgatggcaacaaccaaggctaagccgattgataatggcacaaagaagaaatgaaacaccgtggtcatcgcgaactgaaagcgcgccaaggataaaatacttaatccgagattcataatggtcccccctttattaatttattccctacgaaagcggaaacactttattcacctttcataatagcaagtgataagtgaaatttcaatcaatctcaacttttattcccaaaatagtcaaagccgctaattttcaaggccactattagtacgcttattcgtttgtaagttcacattttgcaatctggcatctgctggtaaaatcacgcgtgactcccgcgaataactgagcttgtcgcatcataaaaatcaatcatcgtactcaatcagttaacaaattagttcatacaataaacaactgatgccgttattaaaaaagtacctcatttaacaagtttagcccgcgaaaacgcaaacaagcctgggttgtcgtgctatattttaaaacgtgcaatagaataaaacgttacgaggagtaaatataatgaaaaggaattcacaacaatcaaccaccgttgatcattataaaatgttcaaagatggcaaacattgggtttacgcggggattaccattgcggggctcggtagtacgttaatgctgacgactaacgccttagcagcaacggctacccccgttagtgccacgaccacttctgcggccaacgccccagctagcgttgccagtcaactcagccaagccgccggggcaacggcaaccgagtcaaccacgacaagtagcatgactactggtgaagacagtaataccacgtcaaataccgacagcagcgctaccactgacaccaatcaaattacgactagtactaacgctactgagactagcgcgactgaacaagccacaagtgcagcgtcagctaccgaccaagctagtgaggttgctaacagtgcgagtggcacagtaactagtcagacgaccagcgctactaattcgacggcagccaataccataagtggtaacgaacaggccgctagctcagcgacgagtgacgctactcaagtcacggatatggtgacagccacgactaaatcaacgaccgattcagctattgattcaactgatgatacgagtaccaacaccaattcgaccgctgcggcaacgccaactagtgtggcgacgaccagcgcggctagtgccgcgacaagtgacagcggtcatggcttaatctacgaaaccaacgacacgactggcaatcaaaagagtacggtcaccattacacaaagtggcccttacagtgtgacctggaaaaaagttactacctctgataagacggacaccaccacggtcacgttagatgccagtgatattgtggccgtcgttaatacgatcaaggacttagcaaatcaagcagcgaccccgtctggaaaagaacaattagcagcagccaaagccaaactgacgacaattcttgacgagttgaaagagctccccacagatatcgccagcacgatcgtgggtaatgtactctacccaatcgtcttcacgggaactggctcagaagccctatctaatttacgtactgaaatgaaccagcaccgctatgacatctccaatacgtggaccggcctcgatccagtcgcttatgctgctgaccgggctgcggccgaagaatattacccgacaacggttacttggtgggataacgttaccaaagaaacctggaccctgcctgaatacaatgacccgacgcagtctgtccgtgcttactatattcaaaatggtgattccaccaagaccgtcatcatcggccaaggttggacggaacatgttgattggatcggctacgtttcaaaaatttggtatgacatgggttataacgtcctcatgccgagtcaacgtgggcagttcctaagtgacggtgataacttaacgtttggttatcaggacaagtatgactggctgaattgggttaagatggtcgacgaacgcaatggcgccgacagtcaagtcgtcttttatggtcaatcattaggtgccgacaccgtgttagaagcagcctcagttcctggactttcaaaatccgttaaagcagttgtgtcggacgccgggtacgcaaccttaccagaactaggtagttcgctatacaacaaagccatcaccgccgtttcaaacgcacttcaatccattggtctgccagccatcacgagcctgcccttcttatcctatgataaaatcgtggccgcgatgaacgctcgtttgatcaaggaacaaggtttcagtgtcgatgacttatcagcaaccgatgcagctagcaaaatcactatcccgttactcttgatccacacgcaagacgacgccttcattccatatactcaatcattggaattagcggccgccaatcattctgccaaccaagaagtttggatcttaccagggactgtcggtggtcacgctgcggctaataacgcgatcctacaataccgccaacacttgttagctttcttaacaccattgctatccgtagcggatgctgaagatgaagcagttgatgttgatcaagtaacggataatcgtaatcagggagcggctgacaacggtacaacgaccgattccacagcacaggacaatgttaccgatgaaacgacagctgatgaggccatcagtgaccatcaaactatcgtggataacacgaccactgacactaccgacataactagtgatacaacaccggacacgaccaatcatgcgaaacctaatgatgattcaacgactagttacgttgacttgaacgacacggataacgcagtggataatgattccgacacggcggttgacgcaacacgtgcgacgaccactgtgaaccagacaagcactatcgatcagagcagcgtgattaagggccaagtcagtgattcaattatggtcagttcaaacgccacgactaacactgactggttagttaatcacgatgacagcggttcggccgtcacggctagtctgcttcaagattatagtgaccaggaagcaagtgtgacgacgccagccacggtatctgccacaacaactaatactgacagtgccgacttagttgccgtctcctcaccagcatccaaagccacaactgagctcccgcagaccgacgaaacaactcagtcatggctcgcaacgctgggtaccagtctcttagccctagcaacggggatttgggcccaagttcggcgacgttttaattagtgaacttttacctgttacgtccactggtgtgttatccttaataaaactatcgtgcgaaaagaggcatcatcatggatattggaacacaagtgacgttcattttggaaggccagaattataccgggaccattgcgaaaagttacactaattcgtatttaatcacctttacaagtcctgatccagccatcgttgataagtatcacaacaaagtaattattagtcagaaacaagttcaagccgttaaatagcgatttaaaacagccacccttgaaattcaggagatttcaagggtggctgttttaaatttgaattgattcaagctagctgtcactttagcgacttattttttaaaacgtagtaatggtgtcccgatcagtggtgtgagaattccagctaaaatcgcttccggaatcccattcgaggccacgatcgttaacaagtacggcattagtttgctcaaattaacttgataaaagccggctgcttgatgactatagagtagcccaatcaaacctaagactagaatcgtgttcgttaatgccccggccacgcccgccagcgtcatccccaacactttttgatgccgcttctgaaaccaaataaagacccaaccggctatcaaaccgacgagaatccggggtatcaccgaaatcaatggattggtaaatacgattggtgctaagggactcgtcggtgcgacgaacgcccgtatccacgcaataattccccatgcgcccccaataattgccccatcacgcggtcccaagaccacggcggccaggataaccgtcacgtgaattgtcgtaatactcaatcctggtaatggaatgtacccaaaaaacggaacaatattctgaatgatcacgattgccattagtaccgctaatacactgatatgataggcgtttgaacgtctctgcatcatcagccacctcaactctctttaccttatgaattatgcgcttaattatagcatatcccaaagcttagtagccgcgaaaagaatgggtgcttacccgccccggtaagcacccactattaattacgattttgattctttggcacgtaaccctgctcgaatacgggagtgccgataactataggcaaagtaaatcacgatgccaataaccagccaaataccaaacatatgccacgtaaatgcctgcaaattaagcatcaggtagacacatgcgaggaacgagacaactggtaacactggataaaatggtactttaaatgaactattgatttgttgtagcgtttcgtgtcgacgcaggaagacaacaccgatagacaccatagcgaatgcaaatagcgttccaatattgactaactccgcaattttatctaatggaatcacagccgcaaatacactggcaataatgccaaaaatccaagtactcttaactggcactttggtatggggactgaccgtccgaaagactttcggtaacaacccatcccggctaatcgcaaacagtaaccgggtcccaccatataacatgacaatcaaaacggtcgtcataccgacaacggcacccagtgacacaatccccgccgcccagttttgatgaatgacggctaaggcatacgccacgggatcacccacgttaagcttactgtaatgcacgaccccgaccagaacggcggccattgccacgtataaaatcgatgctacgactaacgaaccgacaattccgattggcatattacgcttaggatttttcacttcttctgaagcagtcgacaccgcatcaaacccaatatacgcgtagaatgctaacgacgcgcctttgaccagtccgctaacaccatggggcatgaacggatgataattggcaggtttcacaaagaaaattgccacgccaatgaaaagaacaatcactagaatcttaacgattaccataattgaattgacccgtgttgactcttgtagcccaccgaccaataacagtgagacggccaaaaccacgacaaaagcaattaagttgaatccagcaccactgacaccggcagtaccagctgcggcggtcagaaatgttggtagttttaggccaaagccgctcattaaattctgaaagtacgatgaccaacttaccgccaccgaagataccgcgaataaatattctgagatcagagaccaaccaagaatccacgctaagaattccccaaaaacggtataaacgtaagtataggcactccccgccaagggaatggttgaagaaaattcagcgtaacataatgcggccaacgaacacacgaccgcagcaatcacaaatgagagcatggcagccggaccggcatacttagcggcgataattccgggtgtgataaaaatcccagaacccacgattgcgccaacacccatcatggttaaactaaatgcgctcaacgtcttttcgaggccacccttattaaaattagctggattgactgattttttaaccagcaatcgttgtgatgctttcatccggtacgcctcctaatcaaaatcttaataatgcaacgttgttaattctattaatttttgtgcaattagtcaagtaaatctaacaatttcaatcaattcctaattgaatcctttcaaggcagcactttacagcattggttattttaaacaaatttattaataatccataagattcactaattttaatttaaccgcattattatgggttacgacttaaccaacttttgttaatcgccgctgaaaaccgagctgaccagtcccacagtcatacgtcccgacttaaatttgtttctatcatattcatctgtttaaatgcaatcgccacaagcttgtatcttcaagcactcctttcgcaaaaaattaaggtcggtcagctgaaagaattcgactgatcgaccttaattttgacctttaacatattttaatcgggttcaactcaagcagttttgatcaaaaaagaagcatcccgtctctttcaaccggaatacttctaaataaactttaaatatattggatcaaggtcatcaagactggcacaaccacgatgaacaacacggtactcgttgtcacgatgttagtggcgtattccacgtcaccatgtgcttcgttagccaagattggtaacacggctagcattggcgttgctgattgaacaatcaaggtttgcgatgctaaggttgggaaacttgcaccgagattgccagcaaccatcaagacaagaatcatgatgattggtgacaagatgaagcgaccaatcaacgcaacaatcgtatcacggtcaaagcgaatactcttcagaccagcgtcggctaacacgatcccgatataaatcaaggaaagtggtgttactaagtttccaacgtaagtcaacgttgaactgacaaatgataccttcatgattggaatatttagcagtaagaaaattaatgcaactaagaaaccaaccaatggcattggaatgactttcttccaatcaatcttgttatgcgtcttttccttggatttcgtcgggtcgtcgtttgaaatcaagaagaccccaaatgcccatgtcgaaacggtattaacaatatagtaaacaaggaaatacgtcatactcttgtcaccgaacaacgcaatgttcaaaggtaacccaatgaaaatcgtgttggcgttgacgatcgcattgatgaaaatccccttacgacctggacggacccgcataattttaactagcgcaaaggcaatcaagtagccaataatcacggctagaaatgcatatgccaagtaacctgcaaatgatcctaattgcccacgagttagtcggctcagcacagatacgaaaatcgatgctggcaaagcgatatttttgataaatttggaaattgttccagcaaacttatcatcaaaccaacctgctcgtcgtaggacgaaacctaatatcatgatcaaaacgacaactaagacgctttgaattgaattccataaaactcccatgtgctcttataccctcttacaattctcttattttaccgacactatttgctgatggcccggtattctgggacccacttcatatcagcaaccgcttgtttagcatctgcaattggttctttgttgagcttctgatcgataacactttgtgccacgacttcagctaatttttgtgaaaattcagtaattttcgcaactggtggcaatactgcggcacccggcttcgacgtatcaacgattccacctaatgcgtggcaggctgctgacaaggtttcagcgttcagcaccttggctgttgaagcaatcaaaccaaatcctaaaccagggtacatcaaggcgttgtttccttgaccgatttggtaagtgacacctttgtattcaacatcatcagctggaatcccagtcgcaactaaggcccggccgtcagtccatttgattaagtcttccgctttagcttccgctaacttggttgggttagaaagtgggaagatgattggccgttccgtgtgcgccgccatttccttgatgatgctttcagtaaaggtaccaggctgagtcgatgtcccaatcataacggttgggtgaacggctttaacaacggcttccaagttggttaattcgtcagcgttgctaaattcactccgtttgcgcgtgaaggctttttgggctggggttaaaccttccgtgtcgtcaaatagtaaaccttgcttatcaacagcgtagaagtgttgcttagcttcttcttctgttaaaccagcttgcatcaattcatccaagatttggttggcaattcccataccggccgttccggcaccaaatgataagattttttggtccttgatgctttcctttgaaatgttcaatgcacctaagataccagctaaaacaaccatcccggttccttggatatcatcgttaaaggttgcgatttgatccttgtacttgtccaagattacttgcgcattgtcgcgaccgaaatcttcaaagtgtaacaatgaatctgggaataattgttgttcagcagcaacgaacttgtcgatcacgtcatagtattgttcgccggacacacgcttgtgccggttaccaagatacaatggatcatctaataacttctggttgttcgtcccagcatcgatgctaactggcagtacttgtgatgggtcaataccagcggcggcggtgtaaaccattaatttaccaatggcgatatcaacaccgttgacaccccagtcacccataccaagaatcccttcagcatccgtcacaacgactaagcgaatatcacggccgtccgcggcattcttcaaagttgcttcaatatcttcaggtgcatcgacggaaacgaaggccgcattctgtggatccaagaacaattcattatattgttcgatggaatcagcaacgaccggatcataaacgattggcataaattcaaccacgtgttcatccatcagatggaagaacaacgtccggttttcgttaaagagattcattaagaaaatccgttgttccaaacgactaggcttgctcttgaattgggcataagcttgcgtcgcctgttcatcaattgtttgaaccttgcttggtaacgtccccgtcaagccaagtgcttgacgttcctctttggtaaaggcagtgcctttatttaagaatgggttatttaaaatttcacttgcagtttttgtcattactgcggcctcctaattaatttacattttcatcaattttcattgctaggaaaaacgtcctatcaatttacaagtaatactgtaacgccagtaaaatgttatagtcaaaactatgatatgatataaatatattaaataaggtcgctacaaaagctgatttagaaaggaataaaaatgaacacaaaagacttagcttatttcgatgaattaatttctcaaaaaaatttttcaaaagttgcgaaaacattcggtgtgagccaaccaactgtgaccaccgcaatcaaacgcctggagtctgaattcggggcaccactcgtgattcgtgaccgtgttaaaaatacgttacacgtcactgctagtggggcgcaacttgctgaacacgctaaaatcgttttacatgagttacgcctcgcccaccaagaaatcgacaatctatcccaaaatcgactgattttaggattaccgccaattattgaaaaccattattttccaaaaatcggtgcccggttggccgcggaagggctattagccggtctcgaaaccattgaggggggctcgatctggctacgtaacgcggtgcgggacggtcgcgttgacatgaccctacttggttcggtggagccgctcgcttaccaaacgttgattgccgaagaatttgaccgtcagcccttctgtatctacgtgtccaaacaacatccgttagcacaacgtaaacgggtctactttaacgaactacgacgtgaaaaatttgttttctttaatagtaatttcatccataatacggccttcaacaaactcacgcgccggaatcactttcgccccaacatcgtctttcgttccaacgatacccacgttttaatgaaattgattggtgaaaatgtcggcatcggtttctttaccaaaatcgtcgatcactaccgtactgacgtcgtacgactggacttgatggacattgaaccccctgaattcatcacaagcatcgtctaccgaacaacccatattctgacccccgtgcagcaacagctactgaccattttgcacgaaacattagcggttgacactgatcagaccgattaagcaaaactgcaccacccttacagaatagtctgtgagggtggtgcagttttcgtaatcaagacaaattgcgatatatccaaatgaaacaatcgtgaagacacgtcaatctcaaagtaaaagttgaaccactcaaggaatcgtgctgttcacttagacagatggctcagtcgcgacgtttaaatcttcattttaagtaattgatcaataaaccgttgttcatcagtggttggtaagtacccagcccgtgtgaccaccgagatattgaagctgaccggcaattgatctttgatttccaaacatacgacgccatcatccgctttaaccacatcacgaaccagtaagctaatgcccaagttggctttaactaaggctttgacccatgagatatcgggggtccggtagataacttctggatgtaccccggcaaagtcacaataggctcggaaggcttgtgggtgcacgtatttgccatctaatccaatgaactgtgcctgaccgagatccttaaaactaacggcggcttgtttcgccaaactattttgaggactcacgataatactgaatggccgtgcccctaagtgaaccgcacgaactgtcggcaaatcaaatggtaagtaggaccctaataacgcgatgttgatctcaccatgcactaacttacgcaatagctcatctgagcccgtttccgttatttttaactgttgcagtaacccgttctgaagtaacttttccgcaatttgagggaaatataaagtgccaataattggtggtaagccaaaacgaatatcagtctgtaacgtactctgaatttcgcgatgagcaagttgcaaactggcctggatctggcgtgcattcttgtaaagcagctgaccggcccgggtaatatttgtctgttgatggcgacggtcttgaatcaccaatttgactgcaaactctttttccaaccgatgaattgcttgagtcactgccggttgtgagaccgcaaactgcttggcgaccatcgtataattttggcaatcaactaacgcccgaaaataatctaaatcacgtgtattcatccgcgctcaccaaattccttcatgtacatcgccgcaatcttttgctgtagctcagccactgaatgccgccgtgaacgcgcgcaatccttggcttcgcggtgacataataagcaacgacgcttcggcagtcccaaatccgtccgcgacagcgcgcgctgtgaacccgcttgtaagatatcaatatcatataagcgacctaacggatcgtgttcttcaaacgcgaccgccagccgtttgctagtcgcaaagtcagtcgtcagaatcaagaaccgctcattacccgccggatgattccaatcagctgccaccgtgtatgtcgacaactcagcttcaaaccgctggacaccggccaaaaacaaccgtcgtagtgcagcgttattcttaatcggtcccggaatattcaacttgatcgccgcaatcgtggcccgggggttagtcgctgtcaactgttgctgatacgcgacccgttgatcacgggctgctagcattgccgtgattgtttgcggttcaccggttgtaaaaatcgtcgccatgcttgtcactttcttcctatatgtttgttatatttccagcttaaccgaaattagtcgatttttaaactaatttctttggtctctaactacagcccaaatcaaaaatagcccacgcaccgattactcaagcgcatggactattgatttgggttagtcaaaataacttattgtaaatatttgaacatttgttgtccggcttgacggccaaagatcaccgtttcagcgattgagttaccaccaatccggttattgccgtggagaccgccgaccacttcaccggctgcaaacaggccggcaatcggtcgttcgtcctgattcaacacttgggttgctggattaatggcaatcccacccatcgtgtagtgaacagctggcgcaatgtgaattgagtagaacggtcccgccgcaatatcgcgatccatcccagtcgtccggttaaaggccgcatcattatggttagcgactgcctgattccagtcagccaccgtctgtttaagcgtcgcagcgtctaagcctgtcgcagtcgccagtgtttccaagtcagtcccagtctttaccaggccaatgtgatcatagaattcaaccgctttgacccggtcacgaataccgcggtcaaagatcaagtaggcaccagtaccacccagttggtcgatagcggccgtcacgttcttacgcgtgtcgagttcattgacgaaacgagccccctggttatcgaccaaaatcgcaccttcgccccgaaccgcttcaccgattaaataagcatgatctgtatcttgttggaccgtcggatgaacttggacttggtccatatcaaccaacttagccccaatagcttgtgccaacagaatcccatctccagtcgcgcccggctgattggtcgtctgatagtttttaagatcatcacgatactggcctaacaaggtcttattcgcaccgaagccaccggttgctaacaagacggctccagccgtaatcgtgacagctccatctggggttgttgccttgacgccactaattttgccggcttcgacgactagttcatcgactttgacatctgtgaagagtggtaactggtcagccgccacttgtttcaacaactcagtgactaagaaaccaccaatgggagccatggaacttggccgatgggtccgcatcacactcatcccaccagtaatcgtcaaatcatccaacttaatgccgtggtctgctaaccagtcaattgcgagcgcactgtgttccgtgaagaatttcaacagtgcttggttattcataccgccaccacctttaagggtttcgccgtagaaatcgccaaaactatcaacaatatggtgatgcaattggacgttcgtctccgccgcattcataccggatgaagcccgggtggtgttaccaccgattttcgacattttttctaaaataaccgggttcaggcccaattcatgtgcctggattgccgcagtcaaacccgcgccccccgatccaataatcactacgtcatagttcggttttagatccgctaaggcggttggtgtaaatgtaaacttttcagccattgattgccacttctcctctcaattcgtccggggtattccccaggatggaaccaaaatctcatttattattgtcgttaactggacacgggccaccattccaagtctaggaacaatgacccgtgccaccttgatccacgttaacggttcaacgccgatcaatacttattttagcttaatcatcaatattcgtcatatccagtggaaccatccattcatcgaattgttccgcggttactttgccagacttgatggctgcttcacgcaatgtcgtccccgctttttcagctgcttgagcaatcatcgcactatcatgatagccaatatgtggtgacaatgccgtaaccgtcatcaaggaactgtcgactaactctgccatccggtcttggttgaccgtcaaaccagcaatcattcggtcagtgaagccggtaatcgttccagctaacaattcagcagattcaaggaaggcatcaatcaaaacggtcttgtaaacgttcatttcaaaattaccttggctagaagctaaatcgacgaccacgtcattccccataactcgtaccgctgccatagtgatggcttcagcttgggttgggttaactttcccaggcatgattgatgagccgggttcgttagccggaatgtttaattcgtcataaccggcccgtggaccgcttgccaagaaccgcacatcattggcaatcttcatcaaatcggctgctagggtcttgatggccccgtgaaccacgtttaagccagaatgatgggccaaaccatagaacttattggaatcagccgtaaattcaatcccatacaatttgctcatcgccgcagcaatattttcagcaaaatgaggggcagcgtttagaccagtcccaacggcggtcccacccattgcaagctcgcctaacgttggattcaactgttttaagtaggcaatatcatgttcaatcgcactggcccaaccactcacttcttggccaaaagttaatggcgttgcatcttgaagatgggtccggccgatctttactacccgccagtacttcttttgtttgatcttcaattccgctaataagtgttccgctgcggcaatcagcttatccacggcaactgcggccgtaatgttcatcgccgttgggaagatatcgttagagctttgaccatggttaacatcgtcgttcggcaagatttcaatatcaggattgatcttaccagccatgtgtgcgaccacttcattaacgttcatattcgtttgcgtccccgaaccagtttggtaaacaaccagcggaaagtccttacgcaaatcttcatcgtcgagcgctaataacttatcaatggcagccacgattaaatcagctttttcagcagtcattgcttcaacttctttattcgcaatcgctgcggcccgcttaatttgaagtagtgcccgaatcatttccaacggcatcttcgtaccagtcggaaagttatggcgactccgttctgtctgagcaccccataaggcgttcgcaggaattttaacttcgcctaaagtatctgattcaactcgatattctgtcatgttgataacctccaattaatgtgttggtaagcgcttactaagtgtgtgaaaaaaataacatttagtttataaacctagtttagcgcccccatatagctatagtcaaactcagttttagctataagtattagttatgaggtttatgtatcagtatattagcatacaaagattgcttagaatgagttctagataaaaatgtttattttttcacatgttcttatttattcctcttgcttaattttactcataattgtcactttttcttatttgtagacctaaatataccaaaccacaaaatattgagtcatagttgaaaagagatgaaatcaggcaaatcaaaagaacgacgtatggttaactagtaaaacttttttatcaaattcggttgcaatcgagtaggaggtaattgattatttcaattaccgacctctcacaccaccgtacgtacggttccgtatacggcggttcaataatttaagcactctgtatttgctggagtgtcttggacaggtttattagtccaagacgctccagcttttgatttgtatacgtataggttagtgttttattatgggcaatttgccaatatcccttgcgtgtattggcattagtcttggcctgttccggtgtcattcctagcttaattagctcacgatatcgggttttgattttcttccaccgtttccatatcaactgtctaatcctacttcgcaaccattggtccagttgttgaataaacgtcttcatcttgccaatcccatagtactgtagccatcctcgcattttctgtttaattttcttcatcaacattaaccaactaattccacgacttcgcccagtcattatcttaagggcttgtttgattcgctgtttcacgaccttgtgcggtcgtgcatatgccccattacggtctacaccgagcgtaaatcctagaaactttagtcggagtggtgagccaaccgtcgttttatgacagttaattgttagtttcaacttaatttcaagaaagattgtgacattgcgtaagactcgttctcctgctcgcttacttctgacataaatattacagtcatcggcatagcgcacaaatcggtagccccgctgggtcaatagcttgtccaactcgttgagataaatattggccagtagcggcgacaggttcccaccttgtggtgttcccttcgtcgtctttcgaaacagctcgccattcatgaccccgcttgttaggaagcgccgaattaggtggagtagccatggatcagttactcgttgtttgatgaagttcattagtaagtcgtggttaaccgtatcaaagtatgcctttaaatcgaggtctaccacatagtggtagccttgattgtagagttcggtgacactttgaatcgcgtcatgcgcactccgacctggtcggaatccatagctattgtcggaaaatacttgttcgtgtatcggcgaaagcacctgtaccacagcttgttggatcatacgatcaacaactgtaggtactcccagttttctggttgagccatcgagttttggtatctctacccgtctgactggttgcggccgatatattccattacgtaaactctctaggagttcttcccggttcttgtaaatatattcggccagttggtcaacggtcatgccgtcaattccagctacgcccttattcctccgaacacgcttaaacgctaggttcagattactacttgcaaggaaggacccggtctacaaattgaatgccatcctgcgccgtactttcaccgttagtagtactatgcgccccaagatactctttgtcttccagactattcatcccttggcggtcagcttgttcttttttctgcaatcttcgcactaccaacacctccagtatcggtgagaattattattgttcagtccttcatctgccatacggcagattactatgaccttggctgactagtttactcctgtaaacccatatcggcgtccttgttgggagcttatccgacaggcctccccgggtaagaatgatagctttcataccatgcaaccgttggctttactaacttcgacttcaagtagtgtaggacttcagtttgtgaagcaacttcatccagtctaatcagccttgtagccacttcttgtacatcggttcggtattttgtcttaggcttccttcagactccgtctcacggcgaacgcccttgccctcaactcgtggttccgactactacggcccacagcggacttacaccgcctagttatcacccatgccgggcgcacttcaaaaaagaatccaattcataaatgaattggattctagatataacttcatcgacactggttgacagaagccccttattgatgctagccatggcatttcagaaaagcacaatgcctctttataaatccattgaaaatgccgcgtcagacactaatcctggtattttcttagcgattcaaccatagtccaagtactaaaagaacaatcatgatacctaaaattttggcgtggttccaatacttaaacagcaagtcaataattgcaatcacaacaaatacaatcagcaccgacataaaatacaaccaaacattgccattaacactaactgtcacaacaaagccaataacggctagccatggtaaatatttatcaataaatagcttaaaatttgggtattgatccataattaatccaccctaaccaccttatatttctttacaaacgactgaatacgtgaagcctttttacgaatgtgtttcctagatttattcgtataaatatgaataactgttttatattgtactacatacttgttagcgcgcttatacgcccacgcagttaaataagtatttcctgcaggaaaatagctcccaaaaaatgtacccccgaacatccaaattgcttgtccgccatatttggacgcaagcgcctgtactacgtaagtcatgattgctgcagacccagacttctttaacttttttgttattttaacagtttttttgaattttttcctaagtttccattttcccttaggcttaggtgcaactctcttatacttggctgcctgtgcatgtatttcacctatactttctgaaaaaccatcaaaacttgaaaatacactaagtgaaagtatcatagtggtcaaaatcagcatagcaaaaaatttctttaatgtcatctttatattctcctcaaagagtatatttataactaatcattatcatatttaataaaggagcactattgaaaaaagcgcaaaaacattttgcagtatttatacttcagtagctcccaatacacgtttttgcttttcataagattatccaccaacaatccagcttaacgtcataattccaagcatcggtaaataggctaaaaaagaataatatcgtcgtatatgtctaatcttcattaaaaatcccctcctaatacgtatttatattcattttatttcatagttcaatgatactgtgaactttgtgcaaaactcgcacaaaatattaaaattaggtgtgaattcatgaatacaggagaaatcattcatatgttacggaaaaacaaaggaatgtctcaacttgaattagcaaaaaatataacaacacgacgttccataggtgaggtcgagcacggttataaagatttgccatataccacaatgatcaaaataattcagagattaggaatttcgcttagcaattttgaggagtacagacaggggcaccaattttctgccgatcaggcactgataaatgagtttgaaagtatctcagatacttctgaagttaaaaaaatgaaatctattttgaaaaaggctcgacagctggaagaaaaatcgacgttacgctatatccattatataatttgtgttttagatgctcttatacacgttgatacgtacaattgcgatcaacttactaaccttgtcaaacctgtctggaacgaattgtctacggtaagtgtctggaatcatacagacctttttattattaataatttactatatatttttgacttccaaactgcactaagaattgggaaaaaattattactaaacttaaccagtatggagataataatgttttactacaaaatgctatttattctaatttagcattcattaacatgaccaactccaatgcattcggtaaaagcataacaattaactatttacaaaaaagtatcgagttaaccaaacacgctcaccggtatgatttactattattgagtaagatccgtttagcaatggtattgcaacaatacgaagaagcaaaaaaaatgtgctcaatacttacgcgcatgggggctaataacattgtcaatctggtctaccaagattttcctattcttgtaacctaaattcactaatactatcacttataacttcccccgatttattcacaaaaataaatttagcgtagtacaactgaatttaagttaaaacttgggattaaccgtcttagtttattatttttccccataaacctcgatgcgaacaagcgccacacatgttgttaatgacgaatttacaattgaagtgcaacaagtaagaaaaaaataaaaaagaactcatagcctgagtcctataagttgggcgtcactttaaacgatacctatcaagttattgcggagaaaattgggtgttccaaagccaccgtatcgcgcgaaatcaagcgcaatggtggtcgtaaggcatactcggccgtcaaagcccaagagaactatcagggacggcggctaaaaagccgacgtcctaggcttctaactgatttgaagttacgggattttgttcttcactgtattgttcaacgtcagtggtccccggaacaaatttccggtcgtttagtccacgaaaacagtgaatggcatgtcagttataacaccatttatcgtgggattgaacgtgataatttaggcatcaaacgtaagaatcacgaggctcgtggctttgcccgtaagctccgtcaccgtggtaaaacccgaaaggtcaagggaaccattaaggaacgacctgtttcatgtgagaatcgaagctggtttggtcattgggaaagtgataccgttcgcggtaaaaccgggcgttcggccctggtaaccttggtggaccgcaaatctcggtatttattatctcagcgggttcccaaagtaaacgccaagaacgtcacacaagcgatgattgacctcttgcataccgtgacgcccaaacgagttcggacgcttacgccggatcgtggaactgaattcgcaggataccgcgaagttagtcaagagctaagtatcccagtctatttcccagatcctcatgcgtctcagcaacggggaaccaatgagaataccaacggacttatccgtgagtatttccccaaaggaaccgacctagaccaactgactgatcaagatatcgacaagtttgtcagggatttaaatcaccaaccacgtaaggtcttaagctggaagagtccatttgaagttttcttcgggacaaagttgcgcttgatttgacaattcgtcatacaaaaaatgacctagctagcaatttgccaagcaaggtcatttttgtcatcagtatactttagtccttcaccgctttaatcgtatcaataatcgtgccatcgcgatattcaatcaaggcaacggtgcgatctgtaaattcaagtggttggggttggccgactttcttttcggctaattgttgtaattcttcaatcgtatagaccggcacgcctgggacatgactgagtgctttaactaggtcttgacgccgcgggttgattgcaatcccgtattccgtcacaaccacgtcaatggagtcccccggcgttacaacggttgttacttctggcacaatcgtcgctaaccgaccacggacaagtggtgcagagataatggtcagtttggccgtagccgcgtcttgatgtccaccaatggcgccacgaatcacgccatccgaaccggacatgacgttgacattgaagtgcgtatcaatttccaacgcactcagaatggcaacatccaattgatcaaccatcgctcctttattatcagggtcagcgtaccatgatgcgtcaatttcttgttgattaggattggcgtgcatcgatgctgccgcccctttgtcaaagtcttgaacatccatgactttatcaactaacccttcttcgagcaaatcagtggttggtttcgtaataccaccaagtgcaaacgatgctttgatttgattatcgagcattgcttgccgcaagtaccgagtgacagccaacgcagcaccgccggaaccagtttggaatgagaagccgtttttaaagtatggtgagttcacgatcacatcattaacggtctgggcaatcttcaattcctttgggtccttggtgaagcgcgtcgcacctgaaccaatcttgtcagggtcaccaacttggtcgacttgcacgacgtaatcgacttgtgtctgtttaatcgaggccggtgtatttggataagccacaatattatcggtcaataagacaacttggttggcgtattgcgcatccatcagggcgtaacctaaggaaccaaagactgctttaccagccatcccgttcgcatttcctagtcggtcagcattcggaacacctagaaaggccacatcaattttaatatcaccatgttcaatggcccgggcccgattaccatgagaacggaagattacgggattctttaaaccaccgtgtgaaacgaagtccccaagagagccccgcatccccgagctagtaatattcgtaatcgttccagccttgattgcttcgatcaccatatcgttcatcacgcccgttaaggaggatggcgccaaggtcaaatctttaataccggcatcaataatggcccgcatcacttgattgaagacgaaatccccattacgaaaatggtggtgaaatgaaatcgtcataccatctttgacagtggcttttaccacgtcagcaacggaatcaacgactttgttgtcccctgttgaaacgtgaactttgggggccacccgttgaatttcaggatgtccgatttcggttgactcaaaaccttggtaatttaacttcgtcattaattctgctggtaattcgcggtctacactatttttcaatgtaattgccctcctcgtcgagtaagttggaaactttggctaagctcatcacacgttgagcccgcaaaacaacgggccggtctaccatttggccattcatggaaataacaccagaacccttgatccgggcttcctcaatcgcggcgatgactttttgggccttaataacttcatccttggttggttcatagactgaattgaccattgcaatctgtcgagggttgaccaatgatttaccgtcaaatcctaattgatgaatatgccgcgtctcacggtagaagccatcgggatcggccatgtttgtaaagaccgtatcgaacgcggcgattccagcggcacgagcagcatgaagcaccatgttacgggcaaattccagttccgcgccatcaggataacggtgggtcttcatgtccgtcgtataatcttctgctgacaaggcaatcccaatcattcgatccgaggctgccgcgattgccggggcattaagcacgcccttagcgctttcaattgcggccatcaaatgagtcgtaccaactggtatcttaaattcagcttcagctgctgcgacatccttttccaacgtttggatcatggcagccgattcgacttttggtaaacggataacgtcaataccagccttgaccatcgctttgacatcatcagcgtaatacttggtgtccaaaccattgattcgaacgaccaattcagcgttgccataatcttgcgtttttaacgcttcgtaaaccagcacccgggccgcatccttttcagccattgagacggcatcttccaagtcaaacatgatcgagtctgcgccgtaaatcccggcatccttcaccatggctggattattaccaggtacaaacatcattgtccgccgtaagcgttcttcattttcagccattataatacctcccatgctggtgtcgtggtttctaacgcccgttgtgctgccgtaatggtccgcgctttaatgacgcagtccaacgcccctttatcaacagcgcgcaccttcacattatcgatattcaattgttgaagcgtcgtcgtgatcacgtgcttgatttgtgccccgaactgtttgataacatccgattcaaggtcgatttgaatgccgttgtctcccgccattaacataatttgaatatcagatgattccaaggttccggcgactgccgttgtcttaatttccatcaattttcattcctttctgaattcgcgcttgtaatgttgttaggttattttttataaactgggccgttgttgccggtaccagttggtttaactcagttaagttgccgctttgaatccgttgccgaacagtccgcgccgaaattggttgattagccaccgtcgttcgcgatatcactcgtacagcaactgccggtggtaattcacgctgcaaaactcggttataaatcgcagtcgtccgcgacgtcggttcactaccaacgaaccgggtcgtaatgtgcagtgctggtgcaagttgctgcttaaagatccgggcgtccaacgtcgtctgcgcttcaattgcactcgccgctgaatccaagaagtaggctggaaaggtcgctgcactcacgagatagtcctgcccgctgacgacccgaacgttggccaaatcggctgttccttgttgaaccagcttaacgcgctcggccgtacggaatagactcgcatctgtcgcaacgacgaagacgtaaactaaatcactgaccgccgcggcttgttccactaaatagcggtgtccccgcgtaaacgggttcgcattcatgacaatcgcgctgacacgctgttgtgcttggttgggaatcatcggcaactgtttgacaaaatctgtcatatccggtgcgccgttttctaatacggccgcttcatccgaatgagctaattctttaaagcctacgtgttgaaaactcgctgaatacttggccttggtaaataccatcatatgaaagatctgtgcttgaaacagccgattgaccagtgcactcacgatttgattaaaccgggcccccggctgactattcttattacagacacccacatatttaagcacgttgccagctaacgatccggtcccaacaagttggccatcctcgatcaatcctaaggtcacatcaatatgttcaacctcttgcgggctaaaattagtaatccctaatgacgttaagaattgttgccactgggcatgctcgtgcggattatttaattgcatttcaacaacttgcgctgccatcagacaacctcctatgattaatgctgtgcttgcgcgtacgctgcaacggccgccgtcacgttcggtaccacttgtgaatcaaagacgctcggcacaatcgtcgtcgcagttgggttcgacacggtcttagccaaagcctgagccacttggatctgcaacgcattatcaacttgcttgaccccatttgtgagtaagcccttgaagagccccgggaaagccagaatattattgacctggtttggatactggctagaacctgttgcaatgactgtggccccagccttctcagctactgctggatcgatttctggcactggattagcgagtgcaaagacgattggatcatgattcatcaagtggacggcccctgctgataagacgttggcgtctgacaagccaatgaagacgtcctggtcgaccatgaccttcgccagtggttgcccctttagttgtgcaggtgttcccaactgtttggcaagattccgttgatactggttgtaccgctgatcatccgctgtaacgaccccgtaaacatcgaccaaggtcagttgtttgacaccgaccgctgctaataaccgagctgtagctaacccggatgcgccgacgccgttgacaacgatgcgcatctgccgtaaggacttaccgactacgtgagcggcattgatcagtcccgccaacacgacaattgcggtgccttcctgatcgtcatgataaaccggaatatcaagctcatctttcaaggccgcttctagttcaaaacacttaggcgccgtaatatcttccagatgaatgcccgcaaatgagagcgacatgtttttgattgtcgccaccattgctggcacgctgacctgatttaacgccagcggaatcgcattaatccctgcgaggttcttgtataggagtgccttaccttctacgaccggcaaaccacccgcgggaccaatattgccgaggcccagtactgctgacccatccgtgatcaacgctactaatttaccactcatcgtgtattttgcctttaattccggatgcgccgcaatcagcttggaaatcaccgcaacaccaggtgtatatgctttacctaaatcagccttatcggtcactgcaaggtctgaatgaatgtccaaaacccccgtatgggcggcgtgcaactttaaaatctcatcttgttctaccatcaatatctgccttctcttctcaaaataataccgttcactttgttatccccagtgtacgaccattttttaaaaatatcaaatttagattggatttttataatttttaaaaagtcagcttttctggtataataaacttaaaatattataaacgagttttaaaattttaaatcttaggttgataaagaggtcatcgatatggacgatatgaatcatcgccgcctgttgattggaattgcacatgattattacttatccaaaatcaacatcgctgaaatttcaaagaaataccaagtcagtcgttatctaatttcaaaatacttagacgaagccatggcaaccggcctagtcaaaattaacattaacacccccatcgaacgaaatagtgagctggaggctaaatttaaacatcgttttccaattgaacatatttatattatcaaagacgcggataccacgagtgacgatgaacgccacgtaatcgagtttgccgccgaaacaatccagcgccagatcattcaaagtaatgtaattggggtggcatggggtggcactgtccttagcgtcatcgataattttcaaacgagcactcgtgatgacttactgttcacccagtttatgggtgataacctgaaaacgaacgcagcgaacggctcaacaccgttggttcaaaaagccgccgctaagttcggcgcacagtacgtcaccatcccggcaccactctacttgtttaatgatcaagcacaccaagcattggctcaagaaccagccattacaccggccatcagtaactttgaccgaatggacatgctatttgccggaattggcaccttagcatccattgactcgattccggtctggcatcaacatcgccaagccattctgggtggcgctgatccgcaggcggtggtcggcctgttatacggtcggccatacgacatcaatggtcacattctgaacgccgaccacgacaaactctttggcgctaaaatgcccgccattctcaaagtgccgcgtcgttttggcatcatcaaaagtaagttcaagagcgaagccttacttggcgccctccgcggacaattactcactgacatcatcattgatgaagccgtcgcgaatcgggttctccaagaagatcaagccacaccactatccaaataatccgcttcttcgaaaacaggtaccaacgctgaccgttgccggcagcttggtacctgtttttatgcttaaaatcagactaccaaataccaatcactttcatccagagggcgccaatgccaccccaaacgactaggtagaagagacctaaaataaagtttaactgccaccattttccctgagtaacatacccagaaccgaagagaacactcgccgggccgttcgcataatgcgtcgtcgaagcgaagatcgaaccagtaaagccaagtatcagtgcagcaaaggttgctggcgctcccgcggaaaccgcgaccccaagtaaggcaccgtacattgcggaaacgtgggcagtcccactagcaaacaagtagtgactgtagaagtagaacaagacgagtgccgctaaaacaatgccccaactgaagcctttcaaggcaccaccaatcgcgccagacaaccatggaataaagccgagtttgttcaactcattagccatgaagatcaaaattgagaaccacaccaaggtattccaagcaccagtttcgtgtagcacgtcatctaccgatagaactccagcaacgagtagcaaggagacggccataaaggcaactaatgaagcttcgagaccgataaagctggataacatccataagactaaggctagcaagaagacgccgcccatgattttttctggaagactcatcttacccatctttgccagctcatcatccgcccattgcttggcattgggcgtatctttaatttctggtggatacattttataaattaaatatggcacaaccaataaacaaataagtcctgggacaatcccggctaagaaccattgcatccacgataacgtgatgtgtaaactcttggctaacgtgacagcaactaagttaggcgccatcgccgtcatgaacatcgtactggtgattaaatcaccatgaaattctgcgaacactaagaatgaaccgattttactttgtgtgccatccttgggatcagaaccaaacgtttcagctaacgactgaatgattggataaacaatcccaccagcacgggccgtattgcttggcgttgcgggtgctgttactaaatcgacgccaatcagtgcgtatgccaaacccaacgttcgtttcccaaacagccgcacaaacaccaacgcgacacgtcgacctaaaccagtattgatgaaaccacgtgacataaaatacgccatcgcaatcatccataccgtactgctcccaaatccggcaaccgctgtatccataggcacgatgcccaataacacggttagtgtcaacccaatgattgcgaccccggcgattggtaacggccgcgtaatacaaccaataatggttgccacaaaaattgccagaatatgccatgcgttcatcgaaacactggctggtttgataggactacttaaccaaatgatcaggcccaccaataacggtgcaataaaatcacgatacttgaccttatttagtgtcatctcaattcctcctcatacttactcatcatttttatgatgccacattcatcatggtcagcatcttggctgcgaaatgttgcatccgggcacgctcatcatctgatagctcagcttcgatcactttttggagcccgttgcggttaataatggcgggtgaccccaagtacaaatcgttaatgccatattgaccagacaaagcggcggagacaatcaactcagcattttcatcgttcaaaattgctcggcagatttgcatcaaactaacggcgaccccatagaacgtggcccccttctgactaatgatttgaccacctttaccacgaacagcttgctcgatttcagctttgaactgatcatcgaccgttgtgaccgtctttaagggctgagcattgatcataatttcatcaaaattaacgatggaactatcaccatgttctccaagtaccgcagcatcaactgcagtggtggcaacattcaacttctgagccaaggcgacccgtaaccgcgccgtatccaaggaagtcccggtaccaatgacccgatgccgtggaaaaccggataaacgttgcgtcatcgaagtcaaaatatcgacgggattacttgagataacgaagcaaccattaaaaccactcgcaaccactggtttgacgatggattccagaatcttcgtattgcggttaatcaaatctaaacgactctcaccaggcttacgaggcacaccagccgtaatgacaacgatgtcagcatcacgcgcatccgcatattcaccggtatgaatgttggtcgcattcgtaaaggcggcaacatcttccaaatccttaacgtccccctctgcgtgcgttttaaccaagtcaacgataacgagttcatctagggcgcaattttggaccaatgaaaaggcaaatgatgaacccaccgagccatcaccaacaattacgactttgcgttgcttcttatccatgtcaatatccttctttcatcaaaaatgtgtgctgcacatgtggttccaactacttagttacttaactcacaagtattataacgcaaatgctttcatttttgctaattttttaaaaataaattatttttttgaaaaatttaaatataattgttgtttaaaacgcctgcgtagcagcatttaaaattattttgattgtgaactatttctaaagtgtcggcttgtgaaatcattttcgtaagcggttacaatcctgcgtttaaatttcctgattggcgtcaattcgaaacatctgcgcaagttacaaaactttttacccgccaaccgatcttgaaacagttaaaacctgattagcgtggtatattagaagtacgactcaaactagagaggactaatacattggataatgaaactttaaaagactatctcgcaaacaactcccaagttattaccatttttatggagaaagcaaccgattttctgaatcgaaaaaatgaggaccgggcgccagcacgccgctataacgatgctgaaatcacccggcaagcggataagatgctcgatgatgtgattgccaatattcatgataaaatcgtcccccatacccgcgaacaaacaccggctgcctgggaacaatttctgagtgaaaacgacgtacttgatgatctggaactatcaatgacggaattgtcattcgaatcggaagactaaactagcagttcaaaataaagaaagcaatactaagtcactattcttttaaatggtaattataagttgaaacaataatattttcacgagaatttaataccgctcgtaatcggagactcgtttgattatgcaaaatattctgccatggtttcttcggcacgaattgtgggacaagaaccgttgtcgagaagttgcgttccgctgctcgtttagcaatcacatcgcagaatcgtaacgtcggtgttgcaatcgaccgatacgacgaatggatgtccacgaaacggacgtctgggaaggtctctttgaactctgccgccgtcttgtgttccttttcagggttctcatcaaaggacacgtgcatcgcaatgacgtaatctccgatggatcgcgcgtagttgactgcttgagcagttacccgcgtcacattcgagacgaggacgatcaccgttgcaccgtcataatcatgaatcgccgctttttccttggcaaccacgcgtaactgggccgcaacccggttatagtgcacgtggattcggtagaacatgtacagtaagagtggcataacgattaagtatggccaaacattgccgaaatgtagcaagaataggaaaatcactaggagaatcgaaatcaacgccccaagtaagtttaccgccgccttcatccaccaccattgcccccgttcgcggaaccaatgaataatcataccagattgcgacaaagtaaatgggacaaagacccccaccgcataaagtggaatcaaaagcgtcgtcttcccatgaaagataaagatcaacgcaattgccccgaccgccaatgagataatcccattggagtagcccaagcggtccccacgatccatgtaagcatgtggtagaaatttatctttagccaagttataagctaaaattggaaaggctgaaaaaccagtatttgccgcaacggccagaattaacgccgtcgataattgtaacaagtagtagaataagccgtgaccaaagaccgccgtagcaatttgtgacaagacggtattgtctacttgtggtttaacgcctaagtaataacttaaataagtaataccaccaaagaagacggccaagactaatgacataattgctaacgtgttcgccgcattcttgcgtttcggtcgtttgaagtttggcaccgcattactgattgcttccaccccagtcagcgaagacgaaccggaagaaaaggcccgtaagaacagcaccaaggtcatcccttgaaccggtgctccaactgctgcggaggcgtggtaagttaagttaccactcgcaatattcataacgccccatagaatcatgccgataatcataataatgaaaaaataaacgggaaacgttaagaatgatgcggattcgcgcattccacgcaaatttaacgccatgatggcgatgacaatcagtacggcaatcaatacttgataattagctagcgccggaatcgccgacgtgattgcttcagtaccagaagtgacggaaaccgctacggtcagcatataatcaaccagcagtgatcccccggcaactaatccggctggccgcccccagttcgtacttgccaccacgtaggcgccaccgccagatggataagcccgaataatttgtcggtacgacatcgtaatagcaaacaacagcactaacacaagcgccgccacgtacaattgatacatcaacgcggccgctgaaagtgtaatcaaaacggtcgtaatctgttcagtaccgtaagccaccgatgatagcgcatctgacgatagcagcgccagtgccttgaacttggtgagtgcttgcccaccctcgtccatggtttttaacggtttcccaataactaaccgctttaaataacgccacatgataataactcctttattccaaaataattatcccaaagtaaactgagtcaaagtagattctactactttaccctgccaaatactaccagttaaatgtcgggtgcttcaccgcacccacattttgcgttaacgactaatcctaccgctctaatatggataaatcaatacctttattctagtcgattcacaccctaacagcactaaaaaagcacttactcagccgagtaagtgcttaatgttacgatttgtttacatcataccgcccatacctgggtttggtgcggctggtgcagctggtgcattttcttcaggtttttcagcgacaacggcttcagtcgttaagagaagggctgaaacagaagcggcattttgtaaagcagaacgcgttaccttagttgggtccacgataccagctttgatcatgtcaacccattcatcagttgcggcgttgaaaccaacacctggcttttgttccttcatcttttcaacgataacagagccttccaaaccagcattttcagcgatttggcgaactggttcttccaaagcacgtttaacaatgttgatcccagtttgaacgtcaccagtttccttcaatgcagcaacatctttgataacgttaatcaaagcagtaccaccaccagcaacaaagccttcttcaacggcggcccgagttgcgttcaaagcatcttcaatccggtatttacgttccttcaattcagtttcagtagcggcaccgacacgaacaacggcaaccccaccagctaatttagctaaacgttcttgtaacttttctttgtcaaagtcagaagttgtttcaccgatttggttacggataaattcaacccgttctgagatagcatccttggaaccagcgccttcaacaatggtggtgttatccttagtaaccgtaactttgttggcttgacctaattgatcgatggtcgtgtccttcaattcaaggccaaggtcgtcagtgataaccgtcccgccagttaagatagcgatatcttgtaattgttccttacgccgatcaccaaaaccgggtgccttaacggcgacaacgttaaacgtcccacgcatcttgttcaagactaaggttggtaaagcttcaccagaaatgtcatcagcaatgatcaacaatggcttgccttgttcaacgatggattgtaatagtggtaagatatcttgaatgtttgaaatcttcttatcagtaattaagatatatggattgtcaagatccgcttccatcttatcattatcagtaaccatgtattgtgataagtagccgcggtcgaattgcatcccttcaacaacgtctaaactagtatcaacaccacgtgattcttcaatcgtgataacaccgtcatgaccaactttttccatggcttcggcaatcaatttaccagtttcttcacttgctgaagatacagaagcgatttgcgcaatatcttcttgcgtcttaacttcgtgtgccatagcgtgtaatgagtcaaccgccgtcttagtagcttcttcaatcccacgacgaatgccaacagggttagcaccggccgtaacgttcttcataccttcattaacgattgattgtgttaagaccgttgcagtagtcgtcccatcaccagcgatgtcattagtctttgaagcaacttcagaaactaacttagcacccatgttttcgaaatgatcgtctaattcgatcgccttagcaatcgttacaccatcattagtaattgttggtgaaccatatgattgttccaaaacaacgttgcgacccttaggacctaacgttgacttaactgtgtcagctaattgatcgacaccttttagcatcgctgaacgtgcatcttcagagaactttaattctttagccattatctctattcacctcatgaatttaatttattttaagttgcgcaatttaaatggattagtcttcgattgcaacgatatctttttcgtgcaataccaaatacttagcaccttgatacttgacttcggtaccggcatacttatcgaataatacttgatcgccgaccttcacgctggggtcaacttttgtcccgttatctaaaacacgaccgtcattgacggcaacaaccttaccgctttggggcttttccttagcgttattggcaatgacaataccgccaattgtttgttcttcttcttcttgttgttgcaagataacgcgatctcctaatggttttaacacgtgaatccctccatttattcttttttagcactcctcaacctcaagtgctaattacattgtcaactatatcattttaattcaagattgcaagtgatttgtcaattattagtcaaagaatgtcaaatcgactataatgaatactattgaagtatcaataaatcttaaatcaaacttttaaaaggacgtgacttgatggttaatcgccgccaatcaatctttattcttatcatctactttattatttacgcactaccgagcgtccttgtgactgctttccatcagctaggggcccaagtattcgtgattcaaacggtcgactacttagtcggtgcaatcctactcatctggttggcgagtcgcatgcggacaaaaaacgttgttgaaaaacaaccaagtaactggttcatgacgttcatctggggattgatcggtcttgtcctagtcatcgttggtcaagtcatcattttaaaaatgacggctttactgggacagtcaacagcgtcaaccaacacgaccaccctcttaactgttgggcaacaatatcccgctttcttcttagccatcattgtcggtgccccgattatggaagaaatcgtcttccgcaaagttatctttggcaatctaagtgcggttactggtcagattggggcggccttgatttctagtgtgctatttagctttgcacatgcggatggtcactttatcctctatgcctttatcgggttattattctgctggttataccagcacaccggtcggattcaaacatcgatgacggctcacatcctaatgaacgcatcggttgtgttacccacattattaggcttactgcactagtatcattactaggtagcgctaacctagcgtttcaacgttaattttcaccgaatatttatacgttacaatcaatgattcgtgatctaagtatgttaaaaaggctttcctgaataattcagagaagcctttttatagccatttaatttcaaagataaagcgagttattaatcttcagtctcattttcatcgtcattaccattgtcacctaattgctgaccgtaatgttcaatgaagtagatcaatgtttgtaattcgttggtcaaatcaacgttctgaacccgtactgtctcaggaacggagattcgtaacggcgtaaagttcatgattcctttgacgtttgcatcaaccaagtcatcggtaattttctgaacaaccgtggttggcaccgttaagatagcaatctcaatctgttgttcgatcaattgctttttgagctccgtcattgggtacactggaaccccactttggactgtattggcaatcgcctcgttgacatcaaatgctgctgaaatgcggacattactgtttttgtgaaaattaaagttcagtagggcgtggcccaaattaccgaccccaattaaagcaacattcgttaaggtgtcttgatttaaaatctttttgaaaaatgcaagtaacgtttcaacatcgtatccataccctcgtttgccgagcgccccaaaatacgagaaatctcgccgaatcgttgctgaatctactttaaccgcctcggacaactcggtcgatgagacccgcttcttatctgcatctagcaagatatttaaatagcggtaataaatcggtaaccgttttgccgttgcccgtggaatttttgtttctgccattcggacgtgtcctcctaattaaaagtttgtgaatttgctgacactattctagcataacgcgtgactttgtgaaataataattacttattattccgaataattgggtcaggccgttacaatatgctacaattatgtcacgaattaaatgtgaaaggagcttaataaagcgtgattttactacaagtacagcaagttatgcggcgttttggcgccgatgtcttgttcgataacgtacaaatggatattcaagaacacgctcgggtggccctcgtcggtcgaaacggggccggaaaatcaaccttacttaaaatgattgccggcgaaacggtaccggacgaaggccagatttcaatgcgcaagggcttaacaatcggttacttggcgcaagaccaaggactggatagtaacaatacgatttgggaagaaatgagtagtgtctttgctgagttacatgccatcgaaaaacggatgcaccagctcgaaaatcaattgagcgaccccgcaatcatgaatgatgagcaggcttatcaacagaccctgaaaacctatgatcagattcaaactgaatttcaacaaaaaaacgggtacggctaccaagctgagattcggggcgtgttgcacggcttccaattcgacgccgatgtgtacgataagtcggtgacggcactatccggtggacaaaagacccagttggccttggccaagttgttacttgaaaaacgggacttgcttatccttgacgaaccgacgaaccacttggacgtcgaaactcttacttggttggaaagctatctccagtcttactctggtgcgctgctaatcgttagccatgaccgttatttcttagaccgggtcgttaacgaagtctatgacttatcacaccatgaaatggtgcactacactggtaactacgaccagtttgtgcaagaaaaagcggctcgaatccaagcacaatggaaacattatgaaaagcaacaagcggagatcagcaagcttgaagactttgttaatcgtaacatcgtgcgtgcttctacgacaaaacgggcccaggctcggcgtaagcagttagcaaagatggaccgccttgaccgccctgatagtgacgagaagactgcccactttggctttcatgcggctaaacaaagcggcaacattgtgttgaccgtcaaagatgcagccgtgggctatgatggtcagattctttcggaacccgacaacttgaatattaagaaacatgaagctattgccattgttggaccgaacggtattggaaaatcgactttcctaaagagtattttgggacagattccattcattaaaggccaggccgtttttggcaccaacgtcgttacgggctactacgatcaagagcaacgtaatttaaacgacaaaaaaaccgtcctcagtgaactttgggatgaacatcccaccactcctgaaaaagacattcgtaccattttgggcagttttctcttcactggtgaagatgttgataaacccgttcatgccctatctggtggagaacgagcccggttactgttgaccaaacttgccatgcaaaatgacaacttcttaatcttagatgaaccaactaaccacttggatatcgatagccgtgaagttttggaagtcgccctcaacgactttgacggcacccttttgttcgtgtcacatgaccgctacttcattaaccaagtcgccacgagtgtcgtagaggtttctccggaaggcacggaactcttcttaggtgattacgactactacatcgacaagaaacaagagcaagctgaaatcgcggctgcggctgctagccaagcggccgaaaaagctgctgaagccggtgcagcggattcaaccagtgccacaactgctgctccccgctccaaaggccagcaaaattaccaagccagcaagcagcaacaacgtgaaaagcgcaagctcgagcgctcagttgccgccctggaagaacagatgactgccttagatgaacaagccacacagattcaaactgaaatggcgcaacctgaagtatcggccgatgttggtaaactacaagacctacaaaaagaacttgaagccatcaatactcaacaagaacaagttgaaaccgaatggaccgaacaagctgaagctttagaagaattgagctaattttccaatgactcatcagataaaaataatagtcgcctcaagaattaatataattcttgaggcgactattattttgcccctatccgcggcataaatcatgattgaaagaggatgattcctagaatcaaaaatgaccagcttaagcccgctggaaacagttcaagttagtgtaaacttgcttagttagttcgtcctacaccgacctccagtcgggatagcgttcgaatggctgacaaggatatacccaacttttgctgaatttgtcgttgtttttcataaacgttaattttatcaatcaactgtcagattgaaaaggtcttgtgataactcactatttctgaattaccgtagtaataattgaatatttcgaaaaagtggagaaggcactctgatatttaacttaaagggttcagtatcaaaatagccaacgacaaattgtactgagttcagtggccgttcatcagccattcgagcggcttcccgactggagaggctgggtgacaatgctcagtagccaaattattcttagctggaagtgggttgcttccggcttagaataagactcgtatttgagatgacgcgggttatgcgttagctcaaatcgacgtcggcttacgttccagcaattgtcacccagcccccggaggtcggaatcggacgcgcattgctgacgaacaggaatccacctaaccggcacctttcaatcataattaatgaaaagatactaaaacgggtgtgaaaaggactgacttttcacacccgtttataactgcttcattacttcaacatacctggcatccaatcaaattctaagcttggatcggcattcagcgtcgcgtcgccgaattggtgatgctgatattgaacatagcccgcagcaccaatcatggcaccattatcaccgcataactttagaggcgctaagattagttcggtgtcagggaaagcggctggtaaatcttgttgtaaccgttcacgtagcccctggttagctgcaacgccaccggctaagaccaattgcttaactggatattgtttaaggactcgtaacgttttactcatcaggacatcaaccacgctggcctgaaagctagccgctaaatcgttcttatccagagtcgcgccaatttgatctgcgtgatggaccgtattgatgaacgcactcttcagcccactaaaactaaaatcgtaattatcttcatcaatcattgctcgcggaaatttgaaagtgtcgcgacctgcatgtgccatctcgtcaatgactttacctgccggatatggaacacccaatacccgaccgattttatcataagcttcaccagccgcatcgtcacgtgtctcaccaataatctcaaactgcccatctgcttgcatgtagaccaattcagtatgaccgccagaaactaatagtgccattagcggaaattcgaatggcttaacaaaccgagcggcataaatgtgcccggccatatggttaactggaatcagcggtaattggtgcgcgtatgccactgtcttagctgcattaacaccgactaacagtgcccccactagaccggggccatacgtcacggcaacagcatcaaggtcagcatacgtcacgtgtgcctcttgaagtgcggcttcaatacaaattgtaatttgttcaatatgatgacggctggcaacttcaggaaccacgccaccaaaccgtttgtgactattaatctgcgttgcaatcacgttggataaaatctcatggccatctttgatcactgccacactagtctcgtcacaactggactcaaacgctaaaatcaagttttgtttttccacggttcccatccttttaattaatcattttacgcatgatccacgcatcttcttcgggatcatgataatattccttacgcgtggcaatctggtcaaagccgcattgctgatacaagcgctgggcggcgagattactagcccggacttctaggaatacggaccctgccgataattgtgctaagcaggctgttaataaccaccgcgcatgcccttgacgctgataggccggatcaattgcaatattcgtaatttcggtctcatcaagcactgtcgagcggctgacaaacccgatcagttcatcctgccaccgtaataaatcatagtgtaccgttggtaacgccatgtccgccgcaaacgtcgcttgccgccaaggtgcgccaccgggatatgctaatgtcgctaactggtaacaaacttggacggcccgacccgcgtcaagctgcgtactggcgacaagctgtcgttcagtcatccgtagctaccggaatacgataagtcatatcaatagcatcttcatggtcgccaaaatagtaccgtttcttgataccagtcttttcaaaccctaaatcgcggtaaagttgttgcgcaatcgtattactgtaacgaacctcaagggtcaccgtttggtaatgcaacttacgcgcccgcttcatcatgacttgcatcataaaatggcctagtccttggccttgaacatcaggatgtacagcaatattggtgatatgtgcatcttggcggcgatcatcaaagacacaaccacaaaaagcgacgaggcgatcttcatgacgcatcacaatatagaaacgaccgctctgtcggcgaagttccgtcttaaacgcattttcatcccacggtgtctgtcccgcatatacggcccgttcaatggctagcatctcgggcacatcggtaatcagtgcgcgtgagacatagtaattgacttcgcccactttaacgatgtgattttgaatggccaatacacgttggcggcgttgattgccaccggtggtcattttttgaaagtactccttaaattttctcaacatagggcgcatgttccttttctgggtgcttggcttgccaatcacgttcagcttgcgttaaacgcaaatagttcggcacaaagttatgaatttcactcacgggtgtcagcgttcgacccatcaaacctagtactacggcttggggcaagtcaagttgtggggctgcacgaacgaactgcttggctaacgattgctgcaaagcatccgcatattgatcgacatccgcgccgacaaaggtaattggttcatcataactagctaatcgttggccccactcggtcacactgatatgttgatcagcgataacggcaactggacgctggttcttaatccgatataacccggcaaagatgttgtcacgacgcgcatcaaataacggcgccactaattggccttccgtcacaatgttgccagctaacacggccaaactcgatacaccaactaaggctttatctaatgtaaaggcaagtgttttagcagtcgtcacgccaattcgcaaccccgtatacgaccctggtccggcagcaacgacgatccggtctaaatcagctggtgccaatttagcttgagccatggcttgttcaataatcggtaataatgtactactgtggttacggccaacattagtggtcgttgtggccaagatctgggtatcttctaataccgcgacactcaatggccgattcgaagtatcaatcgccaacaacttcataattttaaaaaactcctcattttgaattacttcacatatcttatcataatttacttactttgaaagctttacggtagtaaccaaccaattcaatccagaaacaatcaacaactatcctgaccagtttccactcatacttaccaatcgctgaattgaaaaccgaatgtaaatattatttacataacttatacatatacttcactaatccttgtccgcacatttacaataccttgttatgctacacaagtaactaaaattacttggaggtaattggaaactatgtcaaaagttagtaagtcattattaggtctttcattcatttcggttttaggtttaggactcgcaggttgcgctagcggaaccagtgctaaatctggtggtagcagtacggatagcagcaaaaccatcacggtggtcttctatcctaacgaatcagccaagagttttgctggttcccgtacggccattaagcaagcagttgaaaaggcaacgggtaagacggttaaattacaaaccacgaccgactataacgttgcgatccaagcaattgcatccggcaaagctcaagtcgcatacatgggggctaacggttatatccaagcacaccacaagagcaaagatgttgtaccttttgccgcacaatctgatgctaaaggtaccttgaaagacgctacttataactcctacttaatggtacaacaaaaagatgccaaaaagtatgaagaaaacggtaagtacagtattaagaacgtcaaaggcaagaagatgtcttatgtttccaatagttcaacttcaggcttcttagtaccaacggctgaaatctcacgtgaattcaacatcaaaaccgctgaccaagataaattaactcaaagcggatcattctttagtaaagtgctctatggtggctctcatcagggttccgcggtcaacttactcaagggggatgcggatgtcgctgcctttgatgatgctgatttaatgccatacttaaacgttaccaagggatcatgggacaaggtcggctcaactttcactgttaaggataacgccgaagcgccatttacaagtttagccggcaagtcggtcgttaacattgccatgatgcctgttcaacaaggcccatgggtatacaataccaagtccctcagcaaggatgatcaaaagaagatcgccactgagttcacgtcgaagtcctttgcccaaaacaaaaagatcttctctgaaccaaatgcgaaaacaccaatgatgttccctaagaaatcagaaaagtccaaattagttaatgttaccgacaagtggtacgcgccaacgcataagttagtaggttactaaaccacgtaccattagttcacaatgaaaggatttgccaatgctcaaggttattcagctagataaaacatatggttccaataagcattcgctcaaagcagtcaacttcacagctaaaccgggcgaagtaactgccatcatcggcccgtctggtgctggtaaaacaactattttacggagtatcaatcagttgatccgcgatgatagtggtcaaattttgctcgatgacactgacattcgtcaagcgaacaaagctgaattacgcaaagttcgtcatcatatcggcatgattttccaaaactacaatctgatcagtccgttaacggcccttgaaaatgttctgcatggccgcttaggcgctaaatcaacggttgctggcatgctcggcctttacagtagcgccgaaaaacaagaggcgctacaactactcgacgaagtagggttaaaagaatacgcctaccaacgttgcgatcaattaagtggtggccaacaacaacgggtcgggatcgcacgggcattaatgcaacatcctaagatgattttatgtgatgaaccgattgcttccctagatcccaaatcaacgaccattgtcatggacattctacggcgattggcaaaggaaaaacaactgattatcctcattaatctacatcaggtcgatatcgcaatggcgtacaccgaccatatcgtcggcattaacagcggggccatcgttttcgaaggcgccactaatgaagttgacgacgcggtcttacagcacatttatcgccaacctgaccaatcaacggcggtggctgccaatgaaaactaatccaatgacaccgcaacgcttttttcggcaacgtcggttgcgattatcagttgttttgctcattttaattggcatctacgtcttatccatggccctcgttaattttcaggcgtgggcttcgatcagtaagattccagcgggcttaatgtggttgtttaccaactttattccgacaagtcgttcgatttcttatctgggaccgattctttatcagctgtggcggaccttgctcgtggcaatttcatcaaccatggtcgctagtctcttcgccctgatctttgcgattctcggtgctaagacaaccaccccaacgcctgtcctccgctggattattcgttttggtgcttcactcttacgtaatattccggtggtcgcttgggcgatgattcttctgttttcttttaaacagagtgactttacgggcttcttggcactgttctttatgacgctaggctatctgacacgggcctttactgaaactattgaggacctcgatgccgaaaagcttcaagcactgcaagccgttggcgccaactatttccaatgtgtcttctgtggggtgttacccgaagccgctagtaccttgactagttggattctctacatgattgaaaacaacttacgggacgcaaccttggtcggactcttgacgggtacgggtgttggttttctctttgactactattttaaggcgttccgctatgacgctgctggtctaattgttttgttaattgcgattttagtcattgttttagaattgacatctaatcgaattcggagggcaattgcatgattgaaaacagtcaacccaaaacacaagtacttcaaccgtcagcaccaccaacccggtcgatttcgttggtgactcggccccgcaaaatcctgcgagccgttatgattggcctaacgcttatcagtgtctattcattagtcacactcaataatgccaacctgaacatcattgacgctttgcatagcttaggtctcaacctgaatgctatgttcttacaccctagcgttggtcaagacacactggggcaactcttacgggccctaatgactagtgtttcattagcgatgttgacgactttgttaggagcgctaatcgccttcttcattgccgtcggtgctgcccgtaacttagcacccagttggttagctactagtattaaagcagtcatggcctttattcgtgccattccaacgattttatgggtgttaatttactccgtagtcatgggattaggtgctagtgccgccgtggtcggcttgaccttccacagtgtagcgtacttggttaaggcttattctgaaagtattgaagaaacctcgcaagatacgattgaagcgttaaaggcgagtggcgtgggtttttggccaattgtttttcaggccattctcccgtcaatcattccagcacttcttagctggacgtttatccggtttgaaattaactttgccaatgcggtcgccgttggtgctgcagctggtgctgacgatatcggttactacctcttcatggctggcagtttctacttcgatttccatgaagttggtttgattgtctacctactcttgggtgtcgcaatcgtgctcgaactggtttctatgcggttacgtggccactacttaaagaacaactaagtaaattcaaaggagttttcatcaatgacaattaaagcagtaatttttgactgggccggcacgaccattgactatggcagccgggcgcccatcgtggctttccaaaaagcctttgccaacgttggtattcaaatctctgaagctgagattcgccaagatatgggactagataagtacacccatatccataaaatcatggatttaccggccgttcaaaacgactggcaggcgcgtttccaagtcttaccgactgaagacgactgcaatcaaatctttagcaacttcaaggcaatcttgcttagctccctgactgaattcggacaattaaagcccggcatgtcagctgtaattgactatttgaccgctcacaatatcagctatggcacgaccaccggctatgacgctgaaatgttagctctggtcttaccgattgcagctaagcaaggctatcgtcccgccgtcaacatcacttcagaacaaactggtggtgttggtcgaccagcgccggcaatgcttgcgttagcagctgaacagctcacaatcaccgatccaacgaccgtcatgaaaattggggattccgttaatgatatcttagaaggcaacaacgccgacgcagtctctgtagggattattgatggtagcaacatcatgggactttctgagttagccttcaacgcccttagccccgccgaacaagctgaacgacgagcccacgtcactgccgcttatcaacgcgctggtgccgattacattttacaatcgatggctgaattaccggcattgcttgatcaaatcaatcaaccggttgccactgatcattagcagacaaggagcccgatttttatgaaacaaccttatttactcctaacacccggtccactcagtacgactgccagtgttaaggacgcaatgcaaattgattattgtacttgggatagtgactatcggcacgtcaccgaaaccattcggcaacaaatcttagctatggcccaagccaatccagaaaactatacgaccgtcctactacaaggaagcggcagttttggtgttgaggccaccattggcacagcagtaccacggaccgatgcaactttaatgattgccattaacggcgcatatgggcatcggatcagtcaaattgcagaatattacgatattccacatatcgacgttgtgttcaacgaagatgaagccgtcgatccggttcggattgaagcaaccttagctgatcatccggagattacccacttcgcaaccgttcatagcgaaacgacaactgggattctcaacccaatcgaagccttaatgcctatcatgcatgaacacgggatcgtaacgatcatcgatgccatgtccagtttaggtggcgtcccgattagcattgatgaattggattgtgactacttgattagtagtgccaacaagtgtgtgcaaggcgtgcccggttttgcgttcatcattgcaaaacaagcgaccttggcccacactgctgacaacgctcgttcactttgtctagatctctacgaccaatggcaagccatgaccaagcaaccaggaaaatggcgcttcacttcgccaacccacgtggtacatgcctttgcgcaagcactcattgaattgcaagcagaaggcggcgtgacaccacgctaccaacgttaccatgctagtcaacaactccttagcgacggcttacaagcgctaggttttgaattagtgattgatccagccattcaagggcccatcattacgtcattcaaatacccgaacgtcgactttgattttgctgacttctatcagttcatcaagcaacgcggcttcgtcatttatcctgggaaggtttcaaatatccctagcttcagaattggtaccatcggtgatgttgatacaactgatattcaacgactcttaacaattatcggtgattatcaacaacttcaccgctaactgcattgatcaatctaaaaggtgcgtgccaaggattcaatcctgacatgcaccttttttgacgaccacaaaagcggctttgaaatctattgacgagatttcaaagccgctttcaattatcagctaaccgatactagtcacgatcatcgtagccattgggatgcttctgcgtccaagcccacgctgtttcaataatatcgttaacattgtcataatttggttgccatcctagcacgtcacgcgccttatcactcgccgcaaccaatgagtctggatcaccaggccgccgtggtgctagcttagctggaattggttgcccggtaacttcacgagcagccgctaacatttgtttgttagagaaaccagttgaagaacccaggttaaaggcattgctgtcatttcctgcagccaagtacttcaaagccaagatatgtgcatcagctaagtcgacaacatgcacatagtcacgcacattcgtcccatccggcgtattatagtcatcgccgaagattttaagttcatcgcgttttccttgcgcaacttgtaaaatgattggaaccagatgtgtttcggggccatgatcttcgccaatactgccatctggcttggcacccgcaacgttaaagtaacgtaacgcgacaaacttaatgccataggcgacgtccgcccagtgcataatctgttccatcattaacttgctggcgccatacgggttgattggtaactgtggatcagtttctttaattggaatctgcttaggtgtcccataagtagcggccgttgatgagaagacgatttgcttcacattatgggcctgcatcgtttcaagtaacgtgatcatcccaccagtattgttatcaaagtacttcagtggcttactcattgattctggtacgattgaaaaggcggcaaaatgcacgacagcttcaatatcctcagtatcaaaaacgtgattcaaaaaatccgcatcccgcaaatcaccctgataaaacttggccgccgaattaacagcagcacggtgtcccgtgaccaaattatcaacgaccacgacgtccgtaccgtgttctactaaccgatcaaccatgtgagaaccaatgtagccagctccccctaaaactaaaattgacataatgaacctcccctgtatggatgtattaatcatagcatactgaatcgctagcgactctaataaaaacgtgcgttctaatcgaccaagtcgctcacgatcacatcattaacacactagtgtaaataccaacccagcaaattactgaatcggctctggtaaagtccgccattgaatcgtgacctcacaacacttctcatcatcaacttcgatcaaatgactcgtcgtgacctgatcggccacttcgctcggtaagatgttcgcatgagcagtcaccgtttgcccgtacttgacttcattttcatagcgaacgtcaacgtgaactaaatcatgttgaagcaagaacgtcgcgggtagcgtatctacgagccaatcaaaatagtgtgcattattaacatgccggttgggatcaatgtcaaagaagcggacatggtacggcttcgtaatcgttgtatcggtcgcttcaaaactaatcggtcgtggcaagcgcggaatgcgcttgacgacttccgactgatacggcgcgaccagttctggtaaaatttttacgattcgccgggtcgtttgactcatcatgacccagatactcgtaatataggccaactgttgaccatctgcgtcccgaatccaaaattcacggtaagcaaaatatggattataagcactaccccgaacggcaatcgtaacgacttcgtcttggcggggcatccgtgtaatatcgatggcatattgcgtgacgacccaaccgacaccatggctttgcaccatttccgtcgttaaaccaagggcgtcgctttgatcctctgatgccagtacggcaatatcaattaatgtcgttaaggttgcgcgaccagtgcggtcacattcataatacgtaatccggtgctgttcactgtaaagactcgcatttgcgcctaaagttgccattcatcaagactcctcatcgttggtatttagttcatgaaattgattataaacactttgccggggaatatttcgtcgcttcgcaatcgtcttaatggccacgttgggcttatctccggctgcaatcaacgcttcgacttgggctttgactggcaactgtgccaattcatccgttgtttctggttcatccttatccggattaccaccgatcaaaaggacaaattcgccctttaactgatgatcctgcgcccacgtcaccatttcagccaaggttccacgcgcgaattcctcgtaacgcttagtcaattcccggcacgccacaattggccgcgtcccttcacagacggtcgctaggagggtcaaggtcttggcaacacggaatggcgattcgtacaagaccactgtttcatgtcgccgagccaatttagccaaatcagctttttgttcattcttcttacgcggtaaaaagccgtagaaataaaatggctgtggcactaggccagaagcaatcagcgcagtcaggccggcattggcacctggtagtggcacgactggaatattcgcggcaatgcaggctgccacaagttctttgccgggatcactgattgacggcatccccgcatcgctaacttgtgctaagttaacgcccgtctgtaatttttcaattaactggggaatccgttcttgggtgttatgttcatgaaagctaatttgtttcgttgtaatttcaaaatgattcaataacctttgggtattccgggtatcttctgcggcaattaggtcaaccgttttaagcgtcgccactgcccgataagtcatatcctgtaagttgccaattggcgtcggtactaagtacaaggtcccgatacccgcatgatctgcaaaactttgttgtgtttccaaaacgtcctcctaacaatcctctcgaccgtgacttgttcctatgagtgactcgtggtgaaaagcacaaaaagtctgggactactcccagactttttcgactatgcgcgttcacgttcaccataaatgacttccaaacaaaaaacgcaggattcgtcatcgtcacgccgtttgccgtaaaactggttgcagacgtggaagccctcatcatagagtttttccaagttttgccgtgactttgagagcgtggtcgtgctagccgcttttttcggcaattcattttcaatttcgaccatgtgttcacgtaaatgttcattttcaatgaccaattccgcgtttttctctaacaccgttgtcatatcggcgcgtaacttagccattttgtctagcatttgttgcatctgttgttccatctcaccgaaactatcgtataaatcacgcttatccacgcgctcaccctcgttttcctttatttaagcgtttgtttgaaaaatcggccataactttaacgttaagccttctaagacattttgaaaactaatattgctagctagctggcgcttggccgttaaagctagttctgtcgccgcaatcaactgctcatcgctgacttcagccgttaacccggccaattctttttggtactgaccaaaggttaacgctgtcgttgccacctcaaaatgtaattgcaatagatcttggaacaaggccgcaattaaatccaacataaccagctgatgatcagcgtccttagccaaaccaactaaattgacctgcacagccacaaaactccgtggatcacccttaacagcctggtcaaaccaccgccacaatgcttgcgcagcttgtggtaaccaatcatccgctagcaacgcctgcgcctgggtcacgctatttgtcaggccccgtaacatctgcgcttggtttggcgcaatcccggcctgttcaaacgtctgctgtaacgcctgcgcatttaatggtgggaattcgatcacctgggttcgtgaaataatcgttggtagcatcagttgcttattagtcgttaataacaaggccgtgacgttaccacttggctcctcaataaacttcaataagctattggcagcactcgctgtcatcttctccgcatcattaatgatgaacagtttccggttaccttcgaccgcactcttagagaattcagcttttaagtaacgaacctgatcaacgtgaattcgctgaccctcgggagccactgtcacaatatcagggtgcgacccattagcaatccggacgcactcctcacaagtgccatctggttcaccatcattaatatgcaggcagaacaaccgttgcgcaatccaatgggccagttctggttgtccagcgccttccatccccgcgaataagtacgcgtgggccagatggttctgggcgatgatgtgtttaaatgccgctaataagcggggctgtttcgccgctaacgtttgcgcaaatgactcggttgttgccattaataatcatccttcattaaaattggtgaaattgttcaattggtagaacaaagaccgtggcgccaccgacttgaacttcaactggataggcagctgcgccatccatcgtcacgtctagattgactggtggtgtcataaactgttcccgcgcatgactcgtttctttaatcatggctaaaacttcatccacacggtcatcatcaataccgatcataaaagtggtattacctgaacgtaggaagccccccgtcgttgagagcttcgtggcccgaacattggcttcaatgaactggctgctcaaccggttactgtccttatcttgaacgattgcaataattaatttcattggtcttcccctcccttggatgccacataagccggtaactgtgacgccataatctctaaggcctgcgtcacaacttggtccaatggctgacttgcatcgacgcgcttgatacggtcaggatgatcagccagtaatctcaaatacgctgcttgcacccggtgatggaaacttaaggcttccacgtccaagcgattaatttcattttggcgatgttgttgaatgcggtttaatccaacggcagcatctacgtcaaaatacaacgttaaatctgcggttagccccgcggtcgcgaactgattcatatcataaaccacttgttccccaataccacgaccagccccctgataagcgaccgagctatcgatgtagcgatcacacaagacaagttggtcgttctgcaatgctggttgaatggtttggacgatatgttgtcgccgtgctgccgcatagagtaacgcttccgtacggtcgtccatcgccgtattatgacggtctaaaatgatttttcgaattgcttctgagatttgattcccgcccggttcacgcgtcacaactaagcgatcccctaattgtggctgtaatttggccacaatcgcgtttaaagctgacgttttgccggcaccgtctggcccttcaaaagtaactaattttcctgtcaacattcccaatcccatctattttcttatatgtagcaattgtacttgattttggaaggcctgtctaatccggttgccactagtgagggtattttttgaccgattttagggacgatagctactaccaattgtggttttgataatttattcggtgaattgctaaaaagttattaggtagtactacccacgattgataaataccgattttagtttgttattcattagtagattccaattgccgcacctagcatgtcttaatcacaatgcatgacagattaactggtaaaataatgctagggttctaaatcaaaagacgcacgccatagatttacaaaaatcaacgacgtgcgtctttattttgaaacaagttatctcttaaatcactaacagtctatttatcaatgaccgagcgctgaatcgtctgcccatgaacttgacgtaaacgtgcttcacgatacagatataaatacttagcacgcgctaaggcggtctgcgtaactagttcactcgtattattatcatagaccgcttcttggttctgcttcgcacggtcccagtccaacttagcggcattcagggtcgacaacaactgttcatcaaaaacttccttgggatgcttgatcttctgtttacgtttaaacatggtggcacctccaattacatttcttggcgaccttcaacggctttgaataaggtcatttcatccgcatattgaatatcactaccaaccgacaagccgtgcgccaatcgggtcactttgatccccgccggcttaactaaccgcgagatgtacatcgctgttgcttcaccttcaggcgtggcattggtggcaataatgacttccttgatggcttcattttgctgtagccgtttcaataaactggcaatgttgatatcttccggacctttgccatcaatgggtgacaataccccatgtaagacgtgatacagcccgttgtattccttaatcttttccattgccatgacatccttggcctcttcaacaaccagaacggtgctttgatcacgcgacttatccttacaaatcacacacggatcatcttcggtgatattaccgcaaatactacaaaaatgcaggtcccgtttggccgcaatcagcgacttagcgaactcggtgacgtcatcaccgttcatatcaattgtataaaacgccagccgcgtcgcagtcttgccaccaatgccgggcaacttcatataactatcaatcaacttagcaattggttctggatactgcatgtacttacctcgtttttactgtaatcccttagtatattttcccatcgtactttgtgtctgttcatcgaccttagtcaacgcgtcgttcaccgcagcaacgactaagtcctgtaacatatccacatcatcaggatcaacagcatcagggttaatcgtaatatccttcatcttcttatcaccagtaaaagtgactttgaccatatcgtctggcgccgcacccgtgaaggtttgttcatttaaagccgcttgttcggctgtcatttgcgcctgcatcttcttcatttgtttcatcatactttgcatattgcccattccacgcatcataattatcagttcctttcgtctttagtccggctgtacttcaactaaatcaccgaacatgttcttagcttcttcaacgaccggttctttggccggtgcttgttgctctgatgttgcacctcctggctggtgagtggccaaataatccttacgaatttgtggccactgttctttaggcacacagacaatcttgggtgcctgtcccatcagccgatccaaaccatttccgagtgcatcgatcaaggtctggtcatcaatcgctttttgataaacaaacgcatagtcaaacgcaaccacaacaccttctgaactggccgcaactggttgggccacgtgcattagggcccgctgcgtcacactcaaaatattcatcaaatcagtccaaacatcgcgcaccttaatgagatcattcttcgttgccgctcccagaataggataaatctgactgacattaaccttcttaacaaccgggccattactcgaccgcggcttagccggtgcaggtttagtgatactaccaccttgagaacgtaacgttttgacctcgctttgcaactgttcaacttgttgtgccagtttatgcacagtgggatcttcaggattgaccgttgccgcagctaccggttgaacggccgcttgaccatccaactgagctagcttgaccgtcaacacttctaaataaacgtcggggtgcgtcgtgaaccgcatttgttgttgaatatcgttcaacgtcttgaccatttgatacaggacttcagcatcgatttgcttggcaaatgcttcaaattgttgatcatcctcgcccatcgccacactatcgaccatttcaggggcctgttgatagagtaacacgtcacgcgtataactgatcaaatcttcaatgaaacggttcgcatctttaccttcttgtaagatttgtcgcatcgtctctagtgccggcttcgtatcatggtcggtgacctcactgacatagttagccagcaactgcttggtcacacttcccgtcaccattaacgcatcatccaacgtaaccgtgttatctccaaacgaaattacttgatccagaatacttaaagcatcccgcattccaccttcagcagccgctgcaatgacgcgtagcgctttttcatcataggtcacatccttctcattgaggatgtacaccatccgatcgtagctatccttagctgtaatccgccgaaaatcaaaccgttgcgtccgtgaaataatcgttaatggaatcttatggggctccgttgtcgctaagataaatataacgttagccgggggttcttctagcgttttgagcaacgcattaaacgcgccagtcgataacatatgaacttcatcaataatgtagactttatagtccgcttgcgttggagcatacttcgctttgtcccgaatatcacgaatctcttccacaccattattagaagccgcatcaatttcgatgacatcatttagttgccccttggtaatcgccgtacaagtctcacattcattgcaaggttccccatcaacaagatggtgacagttaattgccttggcaaaaatctttgctgccgacgttttcccagttccccggggaccggtaaacagatacgcatgactcgtctggtgggtcataatggcattttttagtgtctgggtaatcatctgttgcccgacaatctcatcaaagcgttggggacgccaaacccgatatagtgcccgatacatgcgattcttcctttcttacatcagtcatactttggttatcattacttattataagccattgtttaaacgtcctgaacagttagcttcctggttgtgctgtttccactaacgatcagtgtcagttatgcaaattaagcatctaagcgcacttgccaacgagtcgatgcccaggcctttaaccacctttgttaggcgtttggttattccttcaacaaacagtggctttaactatcagcctgaaaagcatcacccaaataacgtattactactataataataggtaaataaaaataaaccaacctatcagcacgttcaaaactagcactcaatatttaatttaaataaaaagctctcaaccgaatggctaagagctgttacatttcataaaaacaaaaggcacaagatgaagcaaacttagtgctgcttccttccggacctgacacgattcgtaaatccacccttgccttttggccttgcggcaaatactataatacatgatttgcgccacaattaccagccatcggcctaatttttttcagcagcttcacgtcgtgcttttttagccgcctttttccgtttacgaatcccacggaagaagttttccaacatctcgccggccggacgtgccaagatgcgttcatgaaccgttacttgatgatttaaccgggtatcatccatcacctgatacaaactacgaacggcgccagccttgggatcacgggcaccaaagtagagttcaggtagccgtgcattaataatagccccactacacatcaaacatggttccaaggtgacatatagctgacaatcggctaatcgccaactatgcaaatattcgcaagcttcctgaatcgcaataatttccgcgtgcatcgttgcatcctgaccatgctcccgtaaattgtgaccacggccaataatttcaccctgatgaacgatcacggccccaatcggcacttcgccaattaagtaggccatccgcgcttcatgtaatgcttcttgcatccagtcttccgctgttggttccgtcacgactatccctcctttacactttgtaggatgtaataccctttgtccttcttaatcacctgacaattaccaaaggtcgtttgcatcaatttcttcgcagatggtgcgccctgctttttctgtaaaacgacggtgagtgttccaccaacgactagccgtgaaacggcccccgttaacatcgcatccaccactgccttacctgcgcgcaccggtgggttggtgacaatcgccgcgtaattagtcgcggtcacttgttgatagacatcagacgtaaaaatattggtattcgtaatttggttcaaagcaacatttttacgcgctaagcttagcgctaactcgttcacatcgaccatatcaaccgttcgttcgggtgattgatacgcgagcgccatcccaatgggaccatatccggttcccaaatctagcattgggcccgctggcaaatcagttgaatcaaacgctgcaagtagtgttcgtgagccgtaatccacggtacgcttggagaagacaccgttgtccgtcgtaaatttaaacgagtgattaaaaatttcaaaattccattgcttttcatcatgcacaatatccggattgtgtgtataataatagttggtcatatttattttcctctaaatttctggtctatatctatgataactgattcagcgagtgaaccacaaataatttaaaaaactttttagtcggttaaaagctgacactaacacaacatctagggcttgtgatttttaccacaccctagatgttgtgttttttgattgtttttttcaccacatgttgtatactaaatttatcagaaaaacgagttaggatgatgaaaaatgaaaaaagttactgtatttactaaaaacaactgcatgcaatgcaagatgactaagaagttcctcacggcgcacaatattgcctttgaagagaagaacatcaatacgaatcctgaatacgtcgattacctgaagaatcaaggtttccatgctgttccggtcgttgaaatcaatggcgaagacagcattgccggcttccgtcctgatgctttaaaacaattagctgtttagtttgttcacgcttttttgcgtggttacatagctggtttaccctttaaaatatgataaacgacccacaatcatcaacctactgattgtgggtcgtcgattttgccagccacaattatactgatagaaagaggattccttatgaccttaaaagatttaaaagacgtcacgtattacgacttaaataatgagatcaatattcccgttaacaatcagattccgctcaacaaggatcaggaggcacttgccgctttccttgaacaaaatgttgaaccgaacacgatgaaatttgatagtcttaaggcgcgctttgactacctacgtgaacacgactatttggaaacccctgccattgataagtatgattttagctttatcgaaaaactttacgattacttgcggtcgcaagacttccacttcaagacgtttatggcggcttacaaattttatgcccaatacgccttaaagacggatgatggcgactattacttggaaaactttattgaccgtgtggcaatgaacgccctctactttgctgatggtaatgaagacttggcgatggacctggccgacgaaatcgttcaccaacgttatcaaccagccacccccagttttctcaatgctggccgggcccggcgtggtgaattgatttcttgcttcttgattcaatcgaccgatgatatgaactcaatcggccggacgattaactccgcgttacaactttctcggatcggtggcggggtcggtattaacctcagcaacttacggggtgccggtgatccaatcaagcatatcgatggcgctgctagtggggtcgtacccgtcatgaaattattagaagacagtttctcctactctaaccaattaggtcaacgtcaaggtgccggggtcgtttaccttagtgtctttcatccagatattattgcctttctttctgctaagaaggaaaacgccgacgaaaagattcggctcaagacgctttcactcggtgtcaccgtacccgacaagttttacgagttgatcaaggctgacgctgatatgtatctcttcagtccttacggcgttgaacgcgaatacggggtaccgttctcatatgtcgatatcaccaaagaatacgacaatatggttaagaacccgaacatccgtaaaactaagatcaaggcgcgtgaccttgaaaatgaaatcagcaagttacaacaagaatctggctacccatacgtcgtcaacattgataccgcgaaccgcgaaaatcctatcgacggtaaaatcgtgatgagtaacttgtgctcagaagtgatgcaagtgcaaaccccatcattaattgatgaccaacaacagtatgagaagttgggaactgatattagttgtaaccttggttcgactaacattgttaacttaatgacctctccagactttggacattctgttgaagccatggtgcgcgcgttaacttttgttactgaccactctaacgtcgacgtcgttccttccatccaaaaagggaaccgtcaagcccataccattggattaggtgccatggggctccatgcctttttcgcgaagaatcagatggaatacggcagtaaagaagccgttgactttaccaatatctacttcttactcttaaactactggaccttaaaagcttctaacgaaattgcgcgtgaacgtcacgaaaccttcgttaactttgaaaaatccaagtatgccgatggttcttactttgacaagtacaccacccaagattggcaaccaaaatatgacaagaccgctgcactgtttgacggtatcttcattccaaccaaagctgattgggaagccctcaaagaagccgttatgcgtgatggcctctatcatcaaaaccggatggctgtcgccccaaatgggtcaatttcgtacatcaacgatacgactgccagcctacacccaatcatcaaccgggtcgaagaacgacaagaaaagaaaattggtaagatttattatcccgctccttacctatctaatgatacaattaactattataagtcagcatacgatactgatatgcgtaaagttatcgatgtctatgcggctgctcaacaacacgttgaccaaggaatgagcttgaccctcttcatgcggtcaactattccagctggcttatacgaatggaaagatggtcgcactgataagatgaccacgcgggacttaaacattttacggaactacgcctaccgcaaagggatcaaatcgatttattatattcggacctttacggatgacgatggcgaagtcggtgttaacgaatgtgaaagctgcgtaatttagtatcttagatctctaggaggataacaaatggcaacagacttggcttactaccaaaaactgctcagtaatggcaactataaggcaattaactgggatcgagtttcagatgcaattgataaaagtacttgggaaaagttaaccgaacaattttggttagacacccggattccagtttccaacgacatggcagactggcgtgaattagatgatgatcaccggtgggtcgtgggacacgttttcggcggtttgacgctgctggatacgttacaatcacaagacggtctgcaagcacttcgccgcaacgtcttaacttcacatgaaacggccgtactaaataacatccaattcatggaatctgttcatgcaaagagttattcaacaatttttgaaacattaaatacgccggacgaaattaatgaaatttttgactggagtgacagtgaagaattcttgcaagcaaaagcccaatggatctacaagctttacgataacatcgacgaagatccattgaaacaaaaagttgcgaacgtctttttggaaactttcttgttctattctggtttctatacgccactgtactacttgggccacaatcaattgccaaacgttgccgaaatcattaaattgattttgcgggacgaaagtgtccatggaacttacattggttataagttccaattaggcttcaaagaccgttctgaaaagcagcaggcagaatttaaagactggatgttcgatttcttatacaaactctatgagaatgaagaaaactacattcatttagtttacgatcaaattggttggtctgatgaagtcttgacttttagtcgttataacgccaacaaagccttgatgaatctcggccaagatgccctcttcccagatactgcggaagacgttaacccggtcgtcatgaacgggatttcaacggggacttctaaccatgacttcttctcacaagttgggaatggttaccgcttgggtcaagttgaagcaatgcaagacaccgactacgatattggtaatccagacgattaatcaacacgttagttcacaaaaatgcggcgcctatccgggccgcatttttgctagaaaattttatcttgggggtagtttagaatggcaattcataatatctgtgttttttgtgggtctaattctggtttagatcccgcatttagtgacaaaacggtggcactcggtcaatacttggccgctaatgattaccaactcgtctatggcggtggcgaccatggtttaatggggaaagtcgccaaagcaactatggatgctggtggccgcgttatcgggattatcccgcattttctggtcgcaagagaacttgcatttaaggacgtcacgacttttatcgaaacgcgcacgatgaccgaacgcaaggaaaagatgcttcacctcgctgacgcctttatcgttttacctggcgggtttggcacctttgaagaattcttacaaatgctatcttggagtcaaatggatattcaccaaaagccgattgcgctctacaacatcgacggcttctacgacgacctagtcgccatgctacaaaagaccgccgacttagggtttgcccccgaggctaacctcgacctattcattaatgggcatgatcttgatgaaattttcgctggtttccatgatttcaaacatgtgttaccgcctaagtatacgaactaaataatctagcctacgcaaaacagctctagtgcttctgccacaattagttcagccctcatcatattagtcggctgaattctaaagtcatcataaaatgccccatcattgcttctcgcagtgatggggcattttgctatgtcattaacgatacttactttatgacatactattcaattatttcaatcgtttcaacaaccatactggccggtgccgctcagacttgtgcacccgggtattaacgacttgtagcaattgtaaaatggtgaaaattagtgaattacgttttcggtacgcaatgtacttcggttcccactcggtcacatacttctctttgtacgaccgtaatccctgaaaaccatataactggtagccatattcgtaaattaaatgagcaattttttcttgaataaaactgtagcgtgaaacccctacaccggataatggtgccattcccatattgaaataagcatagccatcgtcacgcgcctgttcaaataggtgcacaaagaccgtgtccataatgccggatggcgccgatttgcttgaccgcattaagtcaattgaagtcgtctgatgatttccctgcggcataatattcgcaaacgcgacaattcggtggtcaggatcataaacgaccgctacgggtgcctgattgagatactgctcatcaaaaaatccgagcgagaatcctttttccgtctcacctgctaaccaactatccgaaacggctcgtaattcagccataacgtcggcactgaacggtggctgcaagatggcaaactcatagtgatcacgggtaaacttattcattagggcccgctcaccccgtagccgtttaccagccaaactaaagtctgccaatttaacgtgcccttcttcaccagttttgataaagtcaaagcccatttcgtgtaggcgcatcgtcagcatctcactaatttcgtaaaagactagcgagcaaccgtcactatctgcgtcatccaataactgttccaaggcagcttgtaataccgcttgattaccgaatggctctcccataataatcagtttatcggccttctgctggtataagaagatcagttgatcgaccccatcgacttgatagtaatatgctaacttatcattcaaataagccaagtgtgagatttcattgccgccataagtttcaatcacttgtttgacccgagccgcatccatcttttgacgcaatcgggcgttatagccactcgcaaagtagcggtacataataatcaaaatcattgccgctaagactaacccaatcaccccaaataaccagagcttttgtgatgggaagaacagagcttcaggaaccgcatgccgatgatgaatttggggcgcgttatagacccccacaatcgtatacaagataaaggtcaccacatacacgcagctaacccacaacgtttgcccccacgaaaaagccaaccgatcacgataataagcatgccgcgacaaagccactagcgctagaatcacaatcaagaaaatcacaaatttcatcgaaattgcatcataaacgacgagccagcgaatcgtattcaaaattgcaatcagcaggacaatcaccgttggccaaaaagcttttttgacccggccagcagttcccaacgccaccccaatcagtaagaaggccataataatactgctggcctgattaataaagaaaaaggtgtacggataaaactgtaagaagagtttattgttatatgcaaagttagggaccgttgacatcaacaacatcaaaaaaccagaaaagtagagaaaaaccgtcagtaccatctgagcaacacgttgtaatgcctgcttaggaatacccgctaagcgcacgtttaagcgatggccggtgtcatggatgaataagaccaacccgatggcaaacgggataatatagtagaataaccggtaaaataagagccatgcgactgcgtctggtcgagaaactccgaccgcaccgaggccaaaaatcatgaaaacgtcgaatgacccaataccaccgggtaccattgacacttcaccgacaaccgaagcaatcacgaataacggcacgaccgctgcaaaatcaatgggtaatcccataaagtttccaattaataagaagaacagcacacagccagtccattcaccaaacgacccactcaataaccgaacgacgttgccgagcgtaaggccatcgaagaattccgaatcgttgactcgtgtaaaaataaagatggctggaaaatacagtgcaccaccgacgagccagatccagtaactgccatacatgttcccaatgccaaagccatagactagcacgagtgaaatcatacaatataatgacaatcccgaaactaaaaacaaagcgatcttggaaatggcaaacacgatttgtttcttagtggcttcgcgattataaaagttagcacgcagtgaggcgcccagcacgcccccaaaaccaccgatattcgtaaatgtattggtgatccatccagcttttaagatatagccaagtgaatagtggttgggtaaaaactttgtaatcatgacgtcatacgtcagcattggtgtcactgcgataataccaatcacgaccatgcttaacagatgccaccagctttgcgaagcaagcgcattcgccaactgcgcgccactgacttccttcgcaattttgccgacttccgtaatcacaaataacaggacagagaatacaaataatgctttgatgatccccatgcgtttattgagtgccgtcccgattttctgtaacgttgccttcaaaaaaattcccccattggtgtgtttgttctattatcgcaatcttagcctgtttatacaaccgttataggtcgttaataacccccacaggtctgatttgtcgccgtattaagctatgaacattttaaatacctgttactaaattgttccgaatgggtgttagtagttagcactaattatgattaattatcgaaattaataccagcataaaccaatattaattgatttttagttaccaaacttgctttaccaacctttaccgtttatgtataattaaagtgatacataaacaaggaggaatttcttatgcaccatgcaaaaaaactcgtcgttgcactaacgagtctactcatcttaaccggctgtaccactggtaatcaacaagccgccaaccataccagtgtcaaaaccaagacggttcgggttgagaaacggactgctgctaataaagccgcctgggcaaaagcaagggccgctagtcgggctaacgcggcctcagccaaagctcttagttcaaacacgacccaactcgcaattgcaactagtcaggctaagcgtcaatccgaacaactaaaagcaaaacatgacgacgcaatggcctcatcaaaatcagcgtcacaggctgccgccaaatcagctgctagtgaagcggccgcacaatcacgctcccagtcagaagcccagtccgcttcggccgtcgcagccgctagccaatctaagcaagcggccaaggccagcagtcaagcagctgctcaaagtcaacaaactcaaactagtaccgcaaccacgagtcggcagaataatttttctggcgataccgataccgcccaaaccggacgtatcgtgggtaaccgcaattccaaaatttatcacgttgaaacagggcaaaactaccggatggccggtaaaaatgccgtttactttagtacggaagacgcagcgcgggccgctggtttccgtaagtcatttcgataggaggatcacttcatggcattgatcggcaccatcttattatttgcaaccctgtactggttctggcgcttacatcggcgctaccgtgggcgtcaatggtggcggcatagttggccggccattatcgcattgctcgtcagctttagtattctcggcacatctgatgaatccactcagccaactgtgaagacaaagaccgttactaagacacacttagtaacggctaataatgacaagcaattgacggcacttcaggctgccaatcgtgcttctgctagcagcttaaagcaggctgtgaaaaaactttcgagtagtcaacaacatattgacaaactcaaggctacgaacaagcaagctggtgcaacttcgacaacagcaccaaccaaggtcaattctgaccataacccaagtaacactacgttggcgagtaaaacttacaacggtcaacaaacgatcacgattaatcagaatcagcccgcatttaccgctaaggagctcagtacgagtcagggtgcctggcaacaatatggcaatttagactcacttaaccgggtgacggctgctaatgccctcttaaatcagtcactgatgcccaaagctgaacgtgaggccctgaatgttcgaccaacgggttggcataacaaacgcatcagtagcggttggctttacaaccgcagtcatctgattggctatcaattaacggggcagaacaacaatatcaagaacctcatgaccggaacccgttctttgaatgaccctgaaatgacgacctatgaaaaccaagttgcggcctatttgaaagaaagtccgaaaaactacgtccgctatcaagtgacccccattttcaaaggtaacgaactgttagcccgcggtgttcaaatgcgtggtcagtcagttggtagcaatgctgtcagttttaatgtctatattttcaatatccagcccggtatgaccttgaactatactgatggcactagtcaggtcagtcactaacgatcattgatcatcgtattcagcctatcacgcagcagccacaaaagtgatagtgccctgtcgaccagaagttcaacccaagtgaaattttaaaacaagcccaacagacgtactatgcgacgttctgttgggcttgttttgacttgcttaatccaatacggttacgcctctaacgccaagtcaccgtaatcatacggcggttgatatcaagttgcactaacaattagcctaagtataaattctcagtaatcgttatatgcgtggtcatgcacgtgatgattcgcaccaaaaccacatccagagataaaaaaagaccacaccccatagtagggtgtggtctgatgacgttccgttaagtaaataattacttaagggtaacgacaccaccaacttcttcaagcttagctttcatatcgttggcttcgtcttctgaaacgccttctttgatgattgaaggtacgttatcaacaagacccttagcatctttcaagccaagaccagtgatatcacgaacggccttaatagccttaaccttttggtcaccggattcagttaattcaacatcgtatgaatccttagcagcggcagcgtcgccaccagcagcaccggcaacagcaacaggggctgaagctgagacatcgaattcttcttcgatagccttaactaagtcgtttaaatctgagattgaagcttcttttaatgagtcgataatagcatctttatcaaaagccattttttgttcctccattttatatgaacttatattttagtttttttaacacactgacagcaaattaagctgcgtcttcgtcgcctttttcagcaaccgccttaacagcgtatgcaacgttacgaacaggtgcttgtaacaagttggcgatcgtagccaataattcttcacgtgatggcatcgtagcgtattcttgaacagtttcaagatcagcaactttaccttcgatcacgccaccctttaattgaagggcatcagcggtcttcgcgaagttagccaagatctttgcaggagcaactgggtcttcttcagagaaggcaacggcagtaggaccagcaaatacaggttttaagtcttcaaatccggccttatcagcggcacgcaccatgatcttgttcttgataacgcgcatcttaacaccggcttcacgtaattgcttacgtaaatcagttacttgttcaacagtcaaaccacggtaatcaacaacaatggctgatactgagctcttcaattgttctgcaacttcttcgacttcttgtgctttaacagcaattgtttctttactcaacagattcacctcccagaattttggttcagggatttataaaaaaatccctatgtccaccaagacatagagaaaaaacaatgtcctcggcaggtagattaaggccgttaagccgcctgagtcttaggtagagatattacttaacctctagtaatctatcacagatcacccacggggtcaattgttttcagaatttaatccttaaaatgatgctaaatcaacacgtaccgctggggtaaaggttgaagtaacaactaagttttggatgaaagtcccacgtactgaggctggacgagctttcacgatggtgtcttcaatggtcttgaagttaccaactaacttgtcagtatcgaatgataccttgccaacaggaacgtgaacgttaccgtcacggtcagtccggtaagtcaccttaccagcttttgaatcgttaacggctttagcaacgtccatcgtaaccgtaccagtcttagggttaggcattaagcctttaggtccaagaacccgacctaaacgaccaacttgggccatcatgtcaggggtagcgattgcgacatcaaagtctaaccaaccgtcttggatcttctgaactaaatcagtttcaccaacaaagtcagcaccggcttcttcagcttctttagccttgtcacccttagcaaaaacgataacggtttgatctttaccggtaccattaggaaggacaaccgcgccacgaagttgttggtcggcttgctttgtatcaacgtttaatttgaaggcaacttcaacagttgcatcaaactttgcgaaatccatttttttaaccaagtctaccgcttcagttacatcgtaagctttgtcacgatcaacgagcttagcggcgtcttggtattgtttacttttctttgccatctaagtgttttcctccttgcaaatgtggttcaaacggagatttcctcccacttgacacattcattttgatgaagtgtccgacatactcaacagtactgaattagccttcgacggtgaatcccatactccgagcagtaccttcgatcatgcgcatagctgcttcaacgtcagctgcgtttagatcttgcattttagtttcggcgatttgcttaacttgatctttggttacagttgcaaccttcttcgtgttaggttcaccggaaccactttcaacaccggcagctttcttcaatagaacggcagcaggtggggtcttagtgatgaagtcgaatgaacgatcttcgtacaccgtaatcacaacagggatgatcatacctgcttgatcagcagtacgagcattgaaatcctttgtgaaacccatgatattgatacctgcttgacctaaagctgggccaactggcggagcaggtgttgctttgcccgcaggaatttgtaatttaacaacgttagctacttttttagccacgagacattcctccttagtccgtgatgtggtaaatggagctgagtttttgctcctcccacgtaaacgtgcatacgtgacgcacaaacatcattgtagcatatctatttttcaccagcaaccttttttgtggcttctggatataaaaactggacgatttggcgatcaacttcatagttttcatgtaatcgtgaatggcgggcattcttaccatgtaccacaaattcttgatactggtcacgcgtcggtcgcagtaaaaagcgcaatgacaacgcactattcagagcgacagcaccatcactttgcgccgcatcgccaatgttacccgcaatattcaaatacgaaatcgtgtttggcaatcgttggagcgttcgcaaaaaataattataaacgggcgtggtcttagttggtccggtcgccgtcaacgggtggttttcaatcggatacgtattctgcccgacctcactatcattaaacggcgcaccaattgtgacaaccttgcggacttccggtaaattgaccagtttggcagctgtcgtcaggtattgaaagagcaccacaccacccatcgaatgagcgactaaattgatcgtctgaacgtgctcatgcgcaatcaaatactgcacaactgccaagacgcccgccgcctgttgccgtacagcaacgcgtggcgtggcaaaaatcaactgtaccattgggcggtaagcgtctagctcaccagtcacatggggatgattatgtcgatcaatcattacgactaatgacttattggcgatgcccccggccgtaaaacgttggagcatgccaccaaaagagaaccggttgcccgcataccctggaataaatagcgtcacggcgctatcatctgctgaattagccgacaccgactgccgcaaatgctgcggtcgcccgtattgccaaaatttaaaggtgatacgccccaaaataccgagcactaaggcgccgatgatgactaaaattacttctgccaagatggtccaccagcttacttaaattaattaccgaatctggtcaacttgatcgaagtccaattcagtacttgtttcccgaccgaacatattgatattaaccttgagcttcatcttttcgttgtcaatttcagtaatttcaccagaaaggccagagaaagcgccatcgatgatggtaacttgttcgccaacttcaacgtccaattcggtatgccgagcactcatgcctagttgatgcaagatttgttccgcttcttcaggcaacaatggcgttggtttactaccttgcccatgtgatcctaagaacccagtaacacctggcgtattccgaacaatataccaagcttggtccgtcatgaccatttcaaccaaaacgtacccggggaagatcttcttcatttcaactttgtctttcccattcttgacttcatgagcttcttcttcgggaacaacgacccggaaaatattgtcttccattcccatagattgaatacgggattccaagttagaactaaccttattttcataaccagcgtaggtatgtaagacataccatcttttctcaacagactcgaccattattattctcctttaaaatgtcttttggcaaaataaaaaaacctcgtttgcacgaagttttctttcaatgccattattataacaaaaatttgttcaaaaagccattaatgccagcttgttaacatttgtaataataattggataatccaatcaaataaagcgaaaaacgccacgaagaacagtgatgttgagacaactgtccacgaatcacgacgattttcccgccaagttggccaggtcacttttttcatttcatgtccaacttgaccaaaaaatttaaataagcgcatgtctaatccccctaccgcgtttcacgatgaagtgtgtgtttaccacaatatttacaaaatttcttaacttctaagcggtcagttcgattcgggttagcatcaatcgtgtagttccgcgaaccacaaacggtacatgccagtgcaacttttttctgtgccatcgacaaaacctccataataaatcaggtataacattagcatggaacttttcgaatgtcaatttcaggcagcgtcttgtaaaaagtcacgcatcttcttgcggcatcgatccgtggcgttgaccacttgatcaacttccacttgccgactcaatgcaatccgttctggcgattgccctgccaatagatccataaaaaccaatccttcaaatgccgaacagattgctggaaaaatccgcacctgctcacgaacatgaaccacatcaagggtcgaggcccttagcgtctgaatattgcataagatatcctcatcattaacatccagtgataagatatccccttccggacgacgcttgcgagcctgtgtccgccgaatatgatcaataatctgattactcaatagcacccggtaataagtgccaaagctacattgccgtagccgttgatactttttagccgctcgataaactgcaattcgaccttcttgaagccaatcatcctcgtcaaagttccggacatagtattgccgccgcaaccgccaaacaactggcacatactgctgggctaatgcattaatgcttgcatcatcaccatctgctgctaagtggatcaattgctgttcattcacgtgacattcctcgcttctgactagtttcagaaactgcacccctgagcatctgtaatgctaatataccgggttaattgtgccgtcacaagcgaacgaacgtttcaattcagccacctcagcactcacagaaatcttcttatacgcggctatcaaaactactatgatcgtcccattcatcaacctaatagtgctatatcgcactaattattagtaatatcaaaatattgctaacgccaaagacaagtgcgacctacttaagcccgttggagacgagtacgcgcgtccgctggagttgcacgaagccactacgctgtctaaccaaccgattaatgcaatcgccagcgcaaactccgataacactaaaactgttatgacaagccatcctaacatctagtgaacagcagctgaactggggcatttgattactagatattttaatactagaactgctttcgagccttaaattgccactggttatcttttgcaaaatttaaatattaattatgacgatttagaaacagcccacgctcgcggcaaccacctaattacgacctgtgatgatgtttaacgtgattgcgttctagttgttggcggtactgatccaaggccgataattgatcatcattccagggtgatttacgaacggcacctaaatcctgggtgcgcacggcagtatgacgcacatctttcagcgcagtcttgacgcggtgtcgtaattccaaggctggtactcgtaatgcaccttccgaaaagattacccattgttctgcctgatcactagtcgcaaccgtcacttgaagtactcgcgattgcttttcacccgcgtacttttcgatataactgtcagcggtctggtctttactcgtccaaataatctcaagatcagcttggcgataactcttagaattacccggaacgtacatcgcatcaaaaaccaggctaatattaaggcccgtaatttttttatactcagtcaacatgctaattaactcgtcacgagcttgcggcaaccggtccgtttgttttaaatgattgagttctggccagttgccaatcatattgtaagcatcgacaatcaataattgttgtttcatcttattttcccagtggatgccgggacgtgtagccttgataaatcagaaggctggccgccacactggcattcaaactttgaacatgaccaatcattggaatggtcaacatttcgtccacactcttcttaagtaatggtgaaattcccttaccttcattaccaataatcaaaccaacggcaccggaagcatcccactgtcggtagtccgtcccgttcatatcagtcccaaagatccacagaccggcttcttgcaattgtttaaccgtttgaaccaagttcgtcacccgcgcaactttcacgtgttcgatagcccccgttgacgtcttggcaaccgtactggttaaccccacggcgcgccgtttcggaataatgatgccatgggcgccagctgcatcggccgtccgcataatcgaacctaagttatggggatcttcgatattatccaagatcaagaaaaatggcgcttcattcttagccttagcaacagcaaataaatcatcaatggtggcatattcaaaagcagccacccccacagctaccccctgatggttggcgttgtcggttaaacggtctaacttttgtttcggcacgtactgtacgatcaaattacgtttcttcgcaatcttggcaatgtcattcagtacatcggcctgtagaccgctttgaataaagactttgttgatctgttgatcactcttgattgctgccatggcggggtgccgcccgattacaaagtcagctgctgtttggtcttgttcgttatttgacactggaaaccctcccttcatcaacttgtttaatacaccactgtgccagttctgcaattcggtccgcctgctgagtcaattgtaaatacccaaaaacggcttcaaaaccggttgagatccggtaagtgacgacatcggtatgtttggccgacgtatgactcttggcattccgtccacgcttaaaaacgtccacttcagttggcgttaaaacttcttcggcctgcatccgttcgatcagtgccgcttgcgctttggctgaaacatagtgggtcgcgtggtggtgcaacttagtggctttagtaaaaccactttcaatcaaatgttggcgaataaacggttcatacaccgcgtcaccgaggtacgcgagtgcaatcccgtttaattgttgataatcaacttgcatattattcctttctaaaccgcacaccctgaggcgtatcttctaaaataatcccctgagctttcaaatcatcacgaatctggtcggccttagcaaaatccttagctttacgagcagcttctcgttcatcgatcagtgcttgaatcgcgtcatcagccagcgtcgcattagccgtttcaaaagtgacgccgaagacgccagtcaactgcactaatgccttctgtaaggcaatcaacgtctctttttgaaccgttgcctgggctgcatagacattggctaacttagctaattcatacacagcagccaccccgttttgaacattgaaatcgtcatccattgcggttccaaagttagtgatgagtgtctgtaactgttctgccaccgcagtatccgtcccgttcgtcgcatcttgcaaccggaacgtgagattacgataagcattacgtaacttatccaagttattagctgcttcgtctaagttggcctgcgtatattgaatcggtcgccggtactgggtcgtcgccatgaagaaccgtagcacttgcggatcaaccgttttaataatatcgtgaaccgtcacaaaattacctaatgacttactcatcttttcgttgtcatcgccaaccgtcacaaaaccgttgtgtaaccaataattggcaaacgtcttgccggtcttcgcttcactctgggcaatttcattttcatgatgtgggaattcaaggtcctgaccaccaccatgaatatcaaacgtatcgcccaagtacttagtagacatgaccgagcattcaatatgccagccgggccgacccgcaccccatggcgattcccatgaaatttcaccgggcttggctgctttccagagtgcaaagtcaattggatcttctttacgatcggtttcttcatcggcagtatgctgactggcacccacttctaaatcatcgattcgctggtcagataactgaccatactttttaaacttccgtgcgcggtaatatacgtcgccagctgattcgtaagcatagcccttttcaatcaatgcttgtacaaatgcaatgatttctgggatattctcagaggcccgcgggtgaaccgtcgctggttcaatattgaccgcagtcgtatcttccataaaagctttaataaatcggtcagcaactgctggtaccgtggtgtgatcttcagcggcacgtttgatcagcttatcatccacatccgtgaagttggagacatagtcaacgtggtaaccgcaatattcaaaataccgtcggatagtatcaaaggcaattgcagaacgcgcattaccgatatgaatatagttataaacggtcggcccacagacatacattttcacgactccgggggtgataggcttaaacggttctttttgacgcgttaacgtattaaaaacacttaacatattggcgacaactcctttcaattgaatcattacttttgatgatagtttaccatgtttgaaacacaaataaaaagcatccctcgcacggcggaaccgaaactccaccatacaaaagatactttcatatgcagtcacgcgccactgggtaactttcgcgatactgagataacgctcacccggggactagcttgctgaccgcatgatgtattaattgcgttgtcttgctgacgacgaccgccacttacgacaaccaactaatattttaataatccattcattacttggcgagttccgcaatcatagcatcgagatgcttcttggtcgtttcacgccctaataattcaatcgtttctggtaattctggcccgtgcatttcgtgagaaacggcgatccggatcggcatgtataatgcccggcccttgatcttcgtatccttttgaatgctcttgatcgtcttttgaattgcggttgcttcgaagacgtcaatatcttcgattcgttgccggaattccttcaagacagggagtgccgtgtcattatcaagttcggccttagcttcatcattgatatcagccggaccattgaagaagagatctgctaaatcaacgatttgaccagtatagctcatctggttcttaaataatgaaaccaacgtccgtgtccattcaatctggctcatatctgggcgttgtggtaaccggccagccttgatcaattggcgaattgacattgcaaagacttcgttttcgtcagccttcttaatgtactggttgttcacccattccaacttcttgccatcaaaagctgctggtgacttgctcaaccgcttttcatcatacattttgatgaattcgcgcttactgaacaattcactttcgccaactggtgaccatcctagtaggatgatgaagttaagcattgcttctggtaagtaacccaattcacggtattgttcgataaattgcaatacggtttcgtcacgcttgcttaacttcttaccggtttcggtattgataattaagctcatgtggccaaacttcggtggttgccaaccaaaggcttcataaatcatcaattgcttaggcgtgttggcaacgtggtcatcaccacggaagacgtggctaatttccatcatatggtcatcaacaaccaccgcaaagttgtacgttggcatcccgtcacgcttcttgatgacaaagtcgccaccaaccgtcttggattcaaacgaaactttacctttaaccatgtcatcccaagcataggtcgtattttctgggacgtggaagcgaataacgggttggataccagccgccttagcagccgcgatcttcgcctgtttttcgtcttccgtcatgccagcaaattcgtagacgtagtgtggcatttccttacgcgctttttgagcttcacgttgtgccgacaattcgtcttccgtcatgtaagattcgtaagctttaccttcatcaattaattgttgaatcaacgggtcatagattgatttccgttctgattgacggtaagggccaaagtcgccacccttatccggaccttcgtcccaatcaatccctaaccacgtcaaattgtccatctgactcttttcaccgtctttaacattccgctttaaatcggtgtcttcaatccgaagaatgaactttcccttattatgccgggcaaataaatagttaaacaatgcagtccgagcattaccaatgtgtaaatggccagttggacttggtgcgtaacgcacacgaatcttgctctttgccaatgtgattaacgcctctttcgtattttttcatcttaaatgttacgccggaacctttctatcgaccagaatattccgactttcacttgcttttccagtttaccatgtttaccgctaaaaattaaggtttcagactgaacccattgtaaaaatatcgaaacaggccctaatcgtacactaacaacatcccaatttattgataatgagcattaaccctcctattttgttgcgattcggccgcctcccttacgacgtcctggattagtcatcattgaacaaaaaaacggtagcccccatcaaatgagttgctaccgttgaatcgcttcctagtgccgattatcgcgattattatttcgattattactatgattattgttgtgcttattatttccatccgcatgatccgggattccgcgattagcgtgtgctaaacgggcaaaaatcattcgaccagcatccgtttgtaaggcgctcgttacaacgacatccaccttttcattgatgtaaaacttcccatcttcgacgacaaccatcgtcccatcgtccaagtaaccgaccccttgttggcgttcgctaccatttttgacgaccatgacattcatctcttcaccaggaataacccgtggtttcaacgacttagccaactgattaatattgaggacttgtacgttttggaactcaatcaccttattcaagttgtagtcattcgtcacgatcacaccgttgacttttttagccaattgaatgagtttactatcaacttctggaatatcctcaaaatcgccctcgtacatttcaaccgggataatattttcattttgtagcttatttaaaatatctagcccgcgacgaccccgcacacgtttaatactatcagctgaatccgcaatgtactgtaattcatacaagacgaagttcggtactaacagtgttccttctaagaaaccagtcttgacaatgtcgtaaatccggccgtcaatcaagatgttggtatctagaatcttataatgatgatagttctgatctggctgagcatcagtaatctccggacttgtttccttttcacgacggcggaagttgaaaactttccgccactcgtcgatccgggtagtcccgactcgcgcaccaatgtaaccaaaaaacaacatcaaaataattgggacgaccgtgttcaataggaataatggactacgattaaataattgcgaaatcagaaccgcgatcaataacccaataataaatccgatactgccaaataaaagtgtcattggattttgcttggataagttcttttcgactcgatccaccagtcgtacagcggcattggctaagaacaatgacaaaacccatagaatcagcgcccccaacaaaaagttggtaaaaacgttattcaataacacatttggttgcgacaaaattgtcgtccacaagaacggcaggtaagttagtcctaacgtacccccgacgacaataaatactagtcgcaccgttaacttcttcatggcatcagcccctttttaataatttggttgttgtaatgctaattggagcgcttcttttagcgtggcaactccaattacttcgattccagttgggatatcccaaccttgcagattattcttaggaataaagatacgtttaaaacctagcttagccgcctcaccaactcgtgattcaatccggttgacccgccgaatctcaccagtcaaaccgacttcaccaacaaaacagtcactcggacgagtctgctggtcacgataactagaagccacactgaccgcaatagctaagtcaatcgccggttcatctaacttaacgccaccggccgctttcaaatacgcgtcctggttctgaagcattagactcgcccgtttttccaacactgccataatcaaggagactcgattatgatccaagccacttgcggtccgcttcgcattaccaaagaccgttggcgttaccagcgcttgaacttctactaagattggtcgtgttccttccattgaaacaacgatggcggaacccgtagcatccttcagacgttcttccaagaagatctctgagggattggccacttcatacaaaccgcccgttcgcatctcaaatattcccagttcattcgttgacccgaatcgattcttgactgcccgtaaaatgcggtacgtatgatgtaaatcaccttcaaagtacaaaacggtatcaaccatatgttctaagatcttaggccccgcaatggcaccacccttagtcacatgacccacaataaaaatggtaatgccgttagtcttcgcaatttgcagtagttcagccgtaatttcacggatttgtgataccgaaccaatcgcagagtccatatcaggttcttgcatcgtttgtaccgaatcaatgaccacaaattctggatgcgtcgattcaatcgttgaacgaatattcgacatatcagtctcaggataaagataaaagtcttcactgctaacagccaaccggtccgcccgcatcttcacttgggaggcactttcttcaccagtcacgtatagtacggagccacccgtctcggccaattgccccgaaacttgcagtagcaacgttgatttaccaatacctggatcaccaccgatcaaaactagtgaacctggcacaacgccgccacctaagacccggttgaactctttcagcttagtcttgacacgcggtgtcttagtcagcgacacttctttgagtcgttgtggcttagccgacttacccgcaaagctcacccgcgacttgcggtccggttttgtatcaaaatgttcttcagttagtgtattccattcaccacagttcggacaccgtcctaaatatcgcggtgttgaataaccacagttagaacaaacaaactgagtttttgcttttgccacgtacacacgtctccatttctccgccaacatatcaatttaatgttgggtattggaatttctaaaataattacttcatccgcgtcacactgtcatgagtcatgattaaaaggtgccattttttaaatttaaaagcagccagcttaggcccgctggaaacagtccgggttagcgtaaacttgcttagttaattcgtcctacaccgacctccaggcatttctgccaattgccggaacgcggtgggcacagatttgagccgaagcccacgtcttaaatactggcctttcacgcttttatgccatattggtgaaacgtgttcgggtcagactgagacttcacactcttgcagtactgggcattgtcagaaacaccttccagtcgggatggtattcgaatagctgatgaagatgtactcaacttttgatgaattggtcgttgtttttcataaacggtaattttctcaatcaactgtcaggccgaaaatgatattgtgatgacttactatttctgagttaccagtcataatacattgaacgtttcgacaaagtagagaatacattctgatgtttcgctcaaagttttcgtatcaaagtagtcagcaaccaattgtaccaagttaagcggccgtttatttgccattcgagcggcttcccggctggaggggctgggtgacaatgctcagtagccaaattattcttaggcggaagtgtctttcttccggcttagaataagactcgtatttgagatgacgcgggttatgcgttagctcaaatcgacgtcggcttacgttccagcaattgtcacccagtcccggaggtcggaataggatagtcattgcagacgaacagaaatctatctaattggcaccttttaaccatgattcttactaaacaaacagccagcacgatgcagacttacataatcaatcaaactcaattaactggatcgtcattttcatgctatgggtattcacaatcataagtttattttaccattattaatcattaaagcctttaaatcaccttggctttaccgattttttattatttcctatttattggtcgaaccgaagcccccagaacgtgtcgttgtcacattcgtttcatccgtaacagtcagataaggggtaaaaatcccttgggcaatgcgttcaccctttttaatgtgaacgtcgcgaatccccatgttgattaattggacaaaaatcgcgccttcattcttgggattgttatagtagtcggcgtcaatgacgccaatcccattcggtagaatcaagttacgcttcaaggggttgctggaacgattggctaatagtaagtattcgccatcattcataaatgccttaatacccgttggaacaagccatggtttaaggactttagccgccgcatccaaatcggctgcagaactcgtttcaccatgatgtatttgccaaagtactttaataaagttcattttccaaattgacggtaacgtaaaatcttccgccgcttcgaagtcatagccagctgcttgcttggtggtgcggtaaggtacatgtaaccccgcctgcgcgtattgacttacaatttcaaatccccgtgccatttcaaattcctactttctcaacattaatttagtgttcacattttaccatacttttattatagaagtttcgttgacaaaacgggcaattaccggtttaattacggtagatataaaaccctttacaaggtggtgaaatcaatggaattcacgcgtgaagcacaccgcttttattttaatgacgatcacggcaagttggctggtgaaattaccttccccgccatcaataatgatcagacctgggtcattgaacatacctttgttcgtgacgattttggtcatcagggcattgccggccaattaaccaaagccgttattgacgccgctcgagttgaacacaaacgtattcagccactgtgtacctacgctaaggcttactttgatcggcaccctgaagctgccgacgtattagtcactagttctcaatcaaaggagtaattcatattatgaatcaggatcagttaaaacaacttgttggtcaaaaagccgttgaatacattcaagacggcatgcaggtcggcctcggaaccggctcaaccgttaaattcatggttgatgctctgggtgaacgggtcaaaaatgaacatttaaacattgtcggcgtctcaacctccgaccgaaccgctgcccaagctaaggcgctcggtatcccgatgaaatccgttgacgaagtcgaccatctcgacttaacgatcgacggtgccgacgaaatcgccgatgatttccaaggcgttaagggtggtggcgccgccttactcttcgaaaaaatcgttgccatcaattctgataaagtcatgtggattgttgatgaaagcaaaatggtccatcaattaggtgcctttggcttacccgttgaagtgattccttacggcagccaacatgtctttgaaaaaatggctgcccggggctataacccagtattccgtaaagtcaacgatgaactcgtccggaccgattctaataatattatcatcgatttacacatcgacccaatcacggatccccacgctttagccgaagatttaattcacatggttggtgtggttgaacacggcctgttcttagacatggtcaacactgtcattgtcggtcatgccaatggtcccgaggttatcgaagcacgaccatagttttgtgcgactcccggcttgccccacccgtcataaaccgatacaattagaattagattaaaggagagtgatcttttgagtaaagcaatcagtatgaaccaaattgctaactttcaagccgacttggaccaacgtcccgaagcaaaagtcatcgaacgtagtgtcactaagaacggtatcttagcaagcagtcaagatattcaggccatgagccaaaccacaccagtattttccattgatttggatacaggtgacgttgcgaaccaaaagcaaagtggccgttgctggatgttcgccgctttaaacacgatgcggcattcattagctgaaaaattcaacttgaaacatttcgaactatcacaaaactacacctttttctgggataagttcgaaaaagcgaactatttctatgaaaacgtgttggcaaccgctgaccaaccaactagcagccgtaaagttgcctggttgatgaccacgccacaacaagatggtggccaatgggatatgctcgttgccattattcagaagtacggtatcgtgcctaagagtgtcatgcctgaaacttacaacagttcaaaatcggctgaaatcaacagcacacttaacttaaagttacgtaaagatgccgttgaattacgtgaactagtggctgccggaactagtgacgacgcgattcaagaacgcaaggaaaaaatgttaaatgaagtctatcgcatgttagcctatgcctttggcgaacccgtttcacattttgactgggaatatcgtgatgataagaaacaataccacatcgaccaaaacttgacgccacaaagcttcttcgaaaagtacgttggctggaatttggacgattacgtttcaatcatcaacgccccaaccgacgacaagccttataaccatacctacacgattgaaatgttaggtaacgtcttaggtggccgtgaagtcaaacatttgaacgtgtctatggccgacttcaagcaattggccatcaagcaattacaagctggccaaagtgtctggtttggttgtgatgttggtcaatcctccgaccgccaaaaaggggtcatggctaccgatgtctacagtaaagatgaattattcgacgttgacctttcaatgtcgaaggctgaacgtcttgattacggcgaaagtctgatgacccacgccatggttatcaccggtgtcgacctcgttgacggccaaccaactaagtggaaggttgaaaatagctggggcgacaaagttgggactaagggcttcttcgtcatgagcgatgcttggatggacgaatactgctaccaagttgttgttaacaaggaattcttgtccgatgacttaaaggcagcccaagccgaagaaccaactgttttagcaccttgggatccaatgggtgcattagcctaattaagtttaatgggccatctaaattaagcaccatcactgctttagcgtgatggtgctttttggactgcattagacttaactaccgctcaaggaactactaacaacaaacaataaaaaaatcgactaaactcacgcgagtttggtcgatttttttattattacgtttacttatagcaatcactattataattatttatacatctgtttaagcgtactaatttcacgagtcgtaatatgtgctgctcgatgcgactggtaatacatcaccgcactcttgttgttctcgtgctctagtcccagtgcatgtcccaattcatgggtcgcaacggacagcttatattctaccgaatgattgctggctggaaagcgattcgtgtaaatcacacacttcgccgaatccatccaagttgttccttgcgaaccactttgatagtacgtccgccaagtccggccgatttccgatccggtcgtctccgtctcgtcttcactctcgcccaacgtaatctgggctttcgcttggtccttagcctcaactaacctcaccgcgttagtgttattccaacgttccacggctcgtagccaaatcgctcgatacaccttgctgtcactcgtgatccgatacgtgatgacccgactcttaaaacgggccttatagttcaaaaccttagtcccgttatttatataatcatattgatagttatccatctgatcattgtagtagacctgatcatgcgtcgtatcgtgaccactagccttatccgcttcaactcgcgacgcattcgggttgatcagcgtactgatttgtggcgcgaacatcaacagcatcccgcagaaacccaagctcattataattaataataataaatttttatgtttcatcataacgttacccggctttctgatcagatttttggctgtcaagcgcgccaaatcgcaactttgtccaactgatatgttacagcgttcaccattctattacaagttatatattatatttatttatgaaaactgaaggattttattacattaaaaatatttatattaactcaagcagttgtgaaagcactgttatatcaactttttaagcctgtatcattttttgagcactcgtcggcaattattatcaatgattataattacttatactgggcatttatttaacactttaactaaaaaaagagcttcagcgtctgctgaagctcttaactcaggctcgattaatctgataatggtctaaaaaagcagtccagattagcacttactttaaataaaagtaccgcttaggagaactattactaaatttaatactcttctttaccgataacgtgcagttgccgatcaaggtgataacaaattggcactccgttagcaacttcgacaccatcaatcccagtatcactaatatgctctaaatatttgatcatcgcacgcaacgtactaccatgcgccaccacgagttggttttggccgtctaacaaccgcggtgcaatctcatcgatccaataaggcatgatgcggtcgtaagccatcttcaagctttctccccgcggttcgacggcggcaccgtacttggtgtaacgtcgatcatggtctagttcagctggtgtcaacaacggcggcaccgtataaaagctccgccgccactgttgaacttgcgccttaccgtactcttgacgagtcacatccttattttgaccacgtaaggcaccgtaatgtcgttcatttaaccgccacgtcttatactcaggcagccataactgatcaatttcacttaacataatattcgcggtaacgatagcccgttttaggactgaggtatgtacagcgccaaactgcagtcccgtagctcgtaatcgcttgccagcttgatgagcctgtgcaatacccactgctgttagcgggacgtcactccaaccggtatacgtattatcccgattggccgtactctcaccatggcgaaccaatactagttctgtcattctctttcccacctactatcttcaatacttcctatgataatcgatttgattcatttttcaaagtcacaaccagctgttacgtgcgataacgcgcttgccacaaaaaaacggtcaagctgattaatatcaccctgaccgtccacgattaattaattttcttgatttgaaacagcgtgcgcggctttgatgacatgttcatcatcattggcggccgctgttggctgctcaatcgcacccatcgtatcccgttcacggaaccgattaccgacaaaggtcacgacggaaccaatcaaaatcacaacaattccgaccactgtcgtccacaaaatttgttcatggaggattaacgctgctaagattggcgccaaccccggcttaatgaagaatactagggaagccgttgaaacatcggtttgttccattgccaagaaataaaacgcgaagcccccaccagtaacacaaacgccgataaaaaatagtaaccagaaatagttgagattaacattcaccaaaaccggaatggcagcaaattgccgcaaaccgatggccgtcaacccattggcgacagccggaatcttagtaatccaagctaaaactagaagttcaaacgcaccagcaaagaaagtaaaacaagtcatcgtcagcccattcaagccccgtttaacagacccataacgcgagatgatactgtacagcccaaaagtcacggcagacccgatggctaataacagcccgagcccattcgtcaaatgggccggattaacaatgatcaacaacccaatcacagaaatcacgacggagatcaagttagctcgacccaaccgttctcgcagaattaaataggagaataatagcgcaaataccggattacaactaaacaatacggccacagtcgaagcttgatcgaccgtaatcgcgagttggtaaagcgacatactgacaatgacacacactagcccggttaaagcaaatagccgccagtcagcactcactaactttcgtccggtttgctttaatgcccgcaatgcaaatggcagtaacacaattgccccaataaaaaatcgaattagattcaattggattgggttaaaggcactgccggccatctttagcgcaatttccatcgaactaaacattaaggtcgaaattgcaatgtaaagatatgctttcttcacgaaacgttcgcttccttcttaatcaaaatttaatacgcaacggttctcagtatagcaccattttcacgtgattttcaaatcagctcagtatactacctcgcttttatccgcgggaaaacgccttttaacgcggaatcaggcgctattttttcaatttttaattgcttttgaagacaattttcatcaggcttgaaccattcaatggcatcttgccgcctcaaccatcatccagcacgcactcatcagcttgtcatcaaaaactaccagcgagacgtgttgggacggccctgagcagaaagtatctaattggtcaaaccttgttgaccgaactaaattgagttttcatcattaataaccagcaaaaaagcacccgcaacgcctgtcactagtggcacgcattcgggtacttttaattttaagtcacacaataattaacgaataaaattggcttgaacgatcaccatcaaaatcggaataacgatcaggctcaatagtgtcgtttctgtcaccatgaccgcggcataatcggcatccgccccgtacagtttggagacaactggcgcgttcgtcatgacgggcatcgcggactgcagaatgaagacttgcttcatctccaatggaatcgacatcggaataagcatcagcgtcatcagtaccggcgcaaggataaaacgcccaagtaaaattcccaagctatcccggtcgaagcgcatgctgcttaacccggcgttggccattgaaatcccaataaagatcatggacagcggaatcgttagaccgccgatatatgagaaatcatccatcaagaattttggaacgtgaatgtttcctagaacaagcaagacaccaatcataaatcctagtaatggcggtgagaagatcttggtcagtgtctgcttcaagtcaaacttagcggtgccagtaccgtcacgttgaatcaagtaaacgcccagcgtccagaaaatggtggtattggccatgtaataaactaacacgtatggtaatgcgctattcccaaacaaggcttgattaaccggtagcccaataaacaccgtattggagttcaaaaacatggaggcaaataagccgcgatgactctttttaatatttaaggctcgcatcaccccgaacgaaataccaaacaaaatagccatattaagaactggaaaacgtaatcctggcaacgttgataataatttatgcgctgtaaactgctttgtgatcgttgcaatcatataggctggtagcgcaatttgagtgaccaatcgggcaatcagcttagtcgcactttcattaaaccagccccagcgtgccaacaagtaaccaactgcaatcatcacgataatcgtcatgacaccttgaatactctgcacgaatgtctgtaaaatttgcacgctcagtcttcccctcttaacaaattgctcatcattgaatatcgccatcaagctatgtaaaataataattcaatgagaattattcaagtataccactgttttatgatggcttgtaccgtaatttatagatggaaacgtttgacgccggtcacaatattacttatagtgttctataattgtgttactactgatgccagtaattttttgattattaaaatctttttaaattactaactttaaggaccaatgatttgctaaacgtcataaaatgactattgagggaaaaatctaaagtgatgaggaacgaatatgtcagaaaataacaatgataatgaaatgggaccacgccaacgccgctatcgtgaacagcaacagcgtaacccacatttgaaaccacacaaaaaacgtccttggttaattactttactaatcgtcgttgtcctgttgatcgttacgggtggctggtggggctacaagacctggaatgccgctaaggatacgatgaatacgacctaccagtcgaccggctcgaccaagcttcggaatgttgatgccgttattaagaagggcaagccattctcgattctactgttgggaactgatactggtgcactaggtcgcggcaaggacttctcagcccggactgataccatgattgttgcgacaatcaatcctaaaaaagaaagtatgacgctcactagtattccacgggatacgcaagtgatgatcgatgggcaatcacaaaaaattaacgcagcctacaccattgggggcgcaagtggtgccgtcaagtcagtagagaagttactggatgttccaattgacttctacgtcttactgaacatgggtggtttaaaacagatcatcaacgcgatgggcggcgtgaccgtgacacctaagctgactttcaaatacggtaatgccaacgttaagaaaggcgttaagatcaaacttaatggtgcagcggcacttgattactcacggatgcgttatgacgatcctcagggtgattatggtcgtcaaaaacggcaacggcaggttattatggccatggttagtcagtctaactcacttgggtcaattgccaatattgaaaagattacgaaaaaactcgctaagaacatgcgcaccgacttaacttggaatgacatggtcgcactcgatacgaagtacaagaatgcgtctcaccatgccaaatcatataccgttcaaggtactgacgcgacgatcgatgggctctcttatcaagttgcctcttcgtcagaacgttacaagaattcgaagcgcatccgtaaagcgctgggactctcaaacagtaatttaacagagtcagtcttctctgagacagcttcaattacaacgggtagctcaagttccagttcaagttcatcaagtaccacaacgtctagtgataccactacttatggcactagtacgacacaagatacaacgacgcaggaccagaccacgactcaagatcaaaccacgactaatcagtactaagcaactattaaaaaatgggtttcttcagaataaaaattctgagaagcccattttttgatgattatttttaattgaccggccaagattgtaaaaagtgttgaaactttgcttcgcgctgttcaattagatccggtgccggcaatgcttctagtgcggcaagttgggtctcaatcgcctggttgatcgcagcgactaatgtctgatcctgatggtcaataaccaggtcaactaagccgcgcgactgcaaagcgctagctgtcattggtaataaatcgatggcgtcactgctggtctgttgcccatgtaaaatcgcggtgactgcctcgggagaagcaacgttgaaaagtgcatcatctagcatgataatgcggttggcgttggcaaaggctaacgccccaccgctatggccctcaccgagaaatacaacaacgttcggtacggtcagctgaccagtcgccgcaatcaagtccgcaatggcctgactctgaccatagcgttccgattgggggctcgcatcagcacctggcatattgattaagctaacgaccggccacccaaatttagccgcatgggttacgactcttaacgccgtgcgatagccgggaacagttaatgctcccccgttttttcgacgccggctcgcaatatcaacaccccggtcaacgcccagaacagctaattggcgaccagtggcagtgcgcccaaagcccgccgttaaagccgcatcctgacctaataagcggtcaccccgttgttgcgtcattgtcggcaataacgcttgaatgatagtcggcgcactgatccgatcagccgcccgtaatcgctgtaatcgtttatccatgggctgacctcccaatcccataattcactaatgcttgtcctagcgttgaccgcaattgaggtcgttcaacaactgcatccaccataccatttttaaacagctgatccgccgtttgaaaatccgccggcagcttgacaggcaaagtttgttggatgacccgggctccggcaaagccaatcttagcacccgcttctgcgataatcaggtcacccttaaacgcaaaactcgccgatacgccccccatagtgggatctgtcagcactgtgatcaagggtaacggcgttgctgctaaccgtgctaattctgccagaatcaaattcattccgaccaaggcataaacaccttcttgcatccgagcaccacctgaggcggtcacaatgatcagtggtaaccgttgggcccgcgcttgttcactagcatgcaataagcgacgtgtgaccgccgtgtttaacgtccccatcataaaatgactatccatcactgctaagatacagggttgttgctcaatcaaggccgttccacagacaacagcctcgtttaatccggtctggcgttgggcccgccgcagtttgttcgtatagtccgggaaccccagctgattgacaggccgctcagtcatcgtcaacggctgaaacgacccttcgtcgacgagttgttctaatcgttgcgccgtcgtcagtcgttgccaatagtgacaataaggacattgctgataagtgccccattggcgttggtggacgtgccgaccgcacttagggcaggcttgccaggtcccagaagctggataatgactcatttcgacgcctcccaacgtgctagactgtgaatcgtgtactgatcatgaatgtaggccggccgggccaccgtttgctgtagaaaagttaagttcgtcgtgggtcccgtcaatgttacttgcgctaaggcccgttgtaagttgcgcacggcttgctgacggttcgcaccggtgaccatcaacttggcaatcaaaccatcatacatggttactagccgatcgccctgatgataatccgtatccactcgtacatcggctggccagctcagcgtttcaatccgcgtctgcttaaccggtaaggtcgcggtcaaccgagcttcaatcgccgtacacttgggctgcaagccaacatgttctggaaaatcaaccgtaacgccagccgcctgtttgatttgttcagccacaatatcaattccggtggttaattctgtcaccccgtgttcaacctgtaaacgcgtattcatttccatgaaatagaactgaccatccgcaaataagtattcaattgtgcccaagctttgataatgtgtacccgctaataactgccgggacagatcgtataaggtccggcgttgtgtctcagtcaaaatacttgccggactttcttcgagaaccttttgcttgtgcaattggaggctacagtcacgatcaccaagaatgaataatttcgtccccgtaccgaggacttgaacttcaatgtggcgggcagttgtcagaaattgctctaaatacatcgcatcgttcaaaaaggacgcagcagcttcttgacgcgcagcccgcaattgttgatggagttcatgaacgttggtaagcactcgaatacccttgccaccgccaccataactggctttcaaaactagtggaaaaccgatcttggcggccgcgtgtttaatatccggccatgctaagccctgtaatgattgacctgctagtaccggaacggcttgttgccgtgcaaaatccttagcgcgggccttatcacccatcaacttaatttgctcagtctgcgggccaatccaggcaatgccacattccgcacacatggcggcaaaatccgcattttcagctaaaaaaccatatcccgggtgaatcgcatcggcgtgcgtattaattgcagccattagaatcgcttcggcatttaaatacgatccactggcagctgcaggtccgatacagaccacttcatccgctaattgtgtgtaacccgcatgccgatcagcagttgagcaaacggcgaccgtctgaatattcaattgttgacaggctttgataatccgtacggcaatttcaccgcgattcgcgattaacagcttgcgaaacatagctaccgatcctttcgcattgtaaataacggttgttcgtactcaacagtggcgtcgtcagcaactagtactgctgttaacgtcccatcggtcggactaactaatggattgaataatttcatactctcaatctggcctagttcttgaccagctgtcagtgactgaccaacctttaaatctggtgccaagtggaccaccccgaccatcggactcggcagtgtaacgacttcatcttcagtctccgcaactgtgctggcaggcgtagcggctacgggagttaccgtttctgaagctaacgctggttttgtcacttcaatctccaagtcgccggctttaacgcgaatttgctgataaccctgtcgcgcgtatttctcaactaatcgatctaaatcttttaattccatctgcacacccctacttcttgatcaagactgagccatacgctagcccgccaccaaatgctgttaacaacactggcccagttaaggtatcaaaaacattggctaaggccattgccaccccagctgaggacgtattaccataatgatcaacattatgtggaaacttcgtcattggtaacgccaagttagccgcaattttttcaatgatccgtaaattagcttgatgacagatcacgtattgtaaatcactgggtgtcagttgcgcactcgcaattaacccacgcatctgttctggaacaaccgtcgtggcaaattgaaaaacatcccgtccaacttggtaaaacgcatccgtttgcgggtagttcgttgcggcaacttcagtaatcggccgtactcgtccagagtgaatgaccgtagcgtttccttgcgattctaatttctcagcgatcaagctgttttcatctggattgtcagtagcttgtaataacgcgccaccagcaccgtccccaaagaagacggctgccgtccggtcctgaaagtccatcatcttggaattaacttccgcactgatcaccatcacattttggtattgcccactgcgaataaacttgtcagccgttgctaggccaaacgtgaacccagcacacgctgcactcaggtcgaacgcaaacgcattatcagcgccaatattagcttgcactaaacaagccgtcgcaggtgttaaggcatcgggcgtaattgtcgtaactaggatcaaatcaatggcactggcagctaaaccacttttttgtagtaactgctgggcgacctgggtggctaaatccgaggtgttttcatcattcatcgcgtagtgtcgggttttaatcccagtatgcgcctgaatccattcgtcgctagtgtccataatggctgctaattcgtcattatcaacaacgcgtcccggaacatattgtcccatggcggttaattttgtataagttggcatttttaaacccccgctactttccgtttcgattagtttaattttatcaataaaagcctatccgtcaaagtttacggctgtatttttggtaaatccttagaaacctagccaaaatgaaagaacagtggtgcccataaccgacacaccactgtccatcataactttgttaatacttatctggcgccataaagccatttttagctaatagcggcatcacatcaacccgtttatccgtcgggactttctgcgcaaacacctttaatcccgctgcttgtaacgcatataatgcccgtgcttcggcttgaccgattgcaatagcattggtgaccatcaccatgcccgctgaaaaagctagactaccaatatcaatgcccgttttgctaaaatcaagtccccccgctactaagcgcgccatgttctggggcgtatcagttaggattagtggctttacttcatcaaatagcgagtcttgataaatctcgatcattttgtcaactgtaatcacattagctttcacaccagggggtgcggcttgcacaattagaatcttgcgaagtgcatcctgggcaacttcgtctgagacgaccaaaatacggttaggactgaccgtcttggtccacaccgtggcaacttgcccgtggagtagccgactatcaatgcgtgctaaacgaatatccatcgtcatagcggctcatcttccccatcgtcctgtaacaacttgagatgcttaatcccaatctttccagtctcttcaaggtgggcaatcacctcatcaattggcttatcacgaacagtgtaagcctcaatcagcattggcagattcagaccggtaatcagacccatgcgctctgtatgttcggcaacgatccgactagcggcgttaaatggcgaaccgccccataggtcaaccaagaataagacttggtcatccgcgtcaaaccgggcaaccgcagcagctaatttatcagctaattcattaggttcttcgtctagttgaaaggtaaccgtttggaccttatcttgcttgccaaagatcatgtaggatgaatcgacaacgccctgcgcaaaactcccatgactgacaacgacaaatgctaacatctactttccctcctcagtcggttaaatctactcaataagatacatgcaaaaagcatgccaagttagtgtatcaactcatcgcgacctttgcctgatgagtctccaataattgcacaatataataattttcagcatctgagaaggttaactgtagttgatctgtcaattgctgattggcctgttgcacaagtgggtaccacttcgatgccataatgtctggcatctcttcggtgggtgccgaaatttcatctttgatggccgttcgttctagcgcacccgctaagtgcataatcaaatcaatgcgaaaagcattcgtcattacaccatccaagtgcgtcgcaatcacttcgctatactcccataaaattcccgttaacttcttaggatttaaaaacgtgaagtaatcgcctaagtaccgttcgcagagttccggtgtcaactgctgactttcttccgccatggtctgtggcgaatcgatccccgtcgctaactgatcaataaacttttcgccaccaccttgtagcaattcttccaatgaaataaaagggacgtctaattcgggttttgtaatcccagttgccgcaatgatttgataattttgactgatttgttgtatccgtgtcttcatttcgaccactgagattgggaataccgtgataccttcgataaagttttgagctaataaactgtctaaaattgacttgatacgttcagccgtcccaacgccggtcgcacaaattgcaataatcgcccgttgtgccgtcttatccgtcgctaaggcgggcttgactgttgcgcgctgactatccgttggtaggttccgtgaaattcgcgaataacctttgaaaccaacgagctcctgatacatagaatccagatcactatcgaccaggctagccttccgaacggcttccaaaacaaccggcgtggtcaccatgtcaatcgttcgcgtcgcaattcctgtctcctgctgaattcgttccccgaaggtcgttaacgaccccatatcgactagtaacaaaattcctttcccagaatcaagcttttctactcgtcgcttgacatgatcataggcgacactcgggtccatatcgagaggcatgtcgaaagcctgaacatcataatcatctaacaattgtccgacgacctgtgccatggaagacgcggtactcatcccgtgcgctgccaccaacacgccaactttgccgttaagctgcatcgattttaacgagatgagcaaaatggccagataataaacttcggacttgggaatcggtaaatgataccgttcctctaatccttgcttgagcgcctccgctgctttgatttcagccggatattcacgcaccatcgctaacatatccgaactcatttgacgcatgggcttgcctgcctggatgcgtttgataaaggaactgacgtgcaagctcacagcgtaaataaagttatccttgaaattataacctagcatgtcttgaaccgtcatctgcgccgtcttggtaaaatcaatgacgtcctgatcaacgatctcggctaacttgttttctggtgaaacttctaactgattttgtttataaaatgattttaaatgcacattgatatcggtcgtgatgaaacgattgatgtgttctttatcaaggccttcccgtcggagtaacgctgctttatcaccaataatctcatataaattatatggtaattcataattatcgttcttattacgaagcggcgttggaccatcatttggcttcacgatgagaaccgggtccaacaactcagagatggcccccagttcgtgacggttagaggctactgtcatgagaccgctacggatattttgtggcaaatcatccatcgtgattgtgatttcactgtcattttcgatgctattgacaaaaccctgggcacacaccagctgaatgttcgacttcaactgaccgacgttcccaaatgtgactgagccaagtaaggcctgcaccacgtcctccgttaaccgaatctgtttattgattcgattagcttccaatgacaataatgccttcagtaattctaaacgttccttggctgagcgatgattgaacgctggtagctgaatcgtaatcggaattcgccgaacaaaggtctgcagtagggtactttctgggtcctcggtcgttgcgcaaactaagcggacattggcatggtgactcttcgccgtctcaccgagtcgtgaataagtcccgtgatccatgaaataaaaaatcatttcctgaccttctggtggtagacggtgcacttcatctaagaacaacatgcccccatccgcttcttggatcaaaccgtccttatcttcattagcacctgtaaaagaccccttaacataaccaaacaaatgcgacatcaataattccggattatgcgcataatcggcacaattgaacgtaatcaggccttgcgggttcgttaagacttgttgggtttccgcaaaacgatacatggcgtttgcaaagtaagttttaccagaaccagtcgggccaatgattaatgtatttaatccccgcggtgggtaaagaatggccgctttcgcctgttccacttgattagcaaggctctcatgcgagccaatcatgctggcaaatatatcatttacaaccggtttaggcacagacgtcgcgacgtgcgctgtcggtattcgctctgtcgtcgccccattcgctacgccactagttgttgtggccgttgtggctgtcgcattcaccggaacatagtgcacaggccgccctgtcagcttgtgcagctggccttctcgtaccagtgcatttaattccttgctgacgtttgaacgcgctatcattaaagcggtcgctaccatttccgtcgtcagtccgtgtcgatcgctatgttgacggacgtattcacaaatcttggattttctggtcaacttcgccactcctttttctgacaaacaactgtattaatacactttaatactctatattttatcacatagtgtattaaatccatattcagttttcactaaaacattggttcatccattttaatgaatttaagtacaattatgacaatcaagaaaaagcaacctattgaaaaggcaaaccaactatatgcaatgccaactacatttgcaattcctaaaaaaagaagttgtcccaccggtgctccgagcatactgaccatattcaatagtccatcaacagcggccaatcttttctcaggaattgattgcaacactatcgcactgattcgaggatttattttaccgatgaagtatcccattacgaaaagtaatacaatacttaaatacgccgattcgtgccaaataaaactgatgccacacaaccctgaaaatgataagcttatcgcaaataaatacatcaacggaagtttcctaactattccgtttgtaacaagagagccagttatcatcccaattgaaatcatcatattcataatagcaacactgattccgtaattaaccagccacattgttttaaccgataataaggttacattaattaatccagacattgaagctccaaatacattaatgaaaaaagtcaaaatgattacactgaacaaaaaattattacgatacagataccgtaaggtcagtcctagactccttatcatagaaacctgcttccgctctaccatttgcggttctgccacacacagtactccaaaacgatacttaacaagtaatgcggataacaggaaggttagtgcattaatcagtccgacaaccatataattatgatgcaacataacaattattacagacccaatcccttggaaaacgacttgtgccattaatgtcattgccaccataaatcccattgactgcttaagcttgttttcaggcaaaagatgacgtaataacggcagcgctaggccattaccatatgttccaagcgtgtctgaaacaatattaattgataatagcaaaaaaaacagccaaatatttctcggtaaagtaattaaaaaagccaaaattaagaacagaacaaattgtaagtttctcgtaacgagtatcgctctgactttatgtctagactgatcagcaaagtaccctgtaagcatagatagtaatgatggtaccaatgttgccatagatgccaatgatacagctaacgtactaaatgataatgagcctgcatatataacaaaaacaatattatatagtccgtctcctatcccacttaaaacagcaacattaattaatgtctgataaccacggttacacatatattcttgcattactaattcatcttctttaccatctagtttagacagttttccctaaaatcattgacatatcagcatctcaaaacataaagagctagaaaagtacctgcctcaatacttttctagctctcaacctatttcaaataattatctctatttttccctttaaaagcacgtttcaatacatcgaagaatgtcaatgatctgacaattttatctgggtcaacatgtttcctaattgcacgcaaaacgcgttttggatttttagaggaaaatgcgtacattccattttttttagtctttaaagcatagcgtggaatccaacgtcccttaaacatgattgaaacaaccacactatcaacttctgcccatggaatctgaatatagtttcgaacattgcgttcgtcataaaattcgaatcctttgtctcccaccataatctgaccataatccgtaagtcccaaatgtgagttaccttttatcaccaattctactttggtgttaagcgattcaaccatttaaattactccattctattccatttactacttttttaattatacggtgtttaactaattttagcaaaggtctctctaccctaacattaacaatgaaatcggttaataaaacgtatcagttcatcattatgaagtctctcaaaattacaaatatttacatcttcagttgcaacagttataacaccttctaataaatcaaagacgttataattcacagttttatcattctgatccttcaataaaccatgatgcaaataataattagtttttggaatagagtaaaagtcttcatttttgagcttactcacagcctctttagcagtccaaaacactgtatccaactcagaaaaatttacaagttctcgctgctcattctcagaatacacttgcttaatgatagaagcatcaattgtttgccagggctccccatctataccaattggcttgtcagaaactgccacagcaacaaacttgctattatgagtaatcgatagttccatatcctgattagatttaaaaaaaggcttatcattagctcctctaacaagttcaatccgtggctgacggcacagtattgctaacaaggtatatgcaactaaagcattgtattgatcttgtggtcgataaaaactcatagcatactgataacgctcaggagcaaatgccctaacaaatttttctaattttgaatacatgctctgattattcaagtaatacaataattgtttcacttttctttaactacctttgcagctaatcccaaaacatcctgaataaggctcctacttgactcatgaacaaacaaataatcatgaccatcatacacatttttaatcgttacatgcttaaataatagtttgatctgctcatctgttaaaggattctcttctaccatactacgaacaaaggtcgttgcaacattaacttgcttagaatgataattaaaaagatcctcacacacttgatgattattcgcaattaaacgttccgttgtgacattctttttatccattccttcaaaaatatgagtctctgtaaaatattttgcataaaatccgttagcttctcgtttacgaactctttgtaaatcttctgagctaagataaaatgaagaatctaacacagtcaactgattcacatgtagtaaactcgtttcatgctctagctgataacacatctcactagcaacaacgccaccataactccatcccattaaattaatttcacgttttgagctttctggcaaaaatttgttgatcatttgaagataatattttgccagattttcaataccataaatttgatcttcaggattcaacagattatgtggttcaatgacatatatcggaaagcttggccgcttaattcccgtaaataatggtcgatacacatcactcccagtattaccagagtgaattacaaagagagcaggcttgtcacccatatcatccgttcgtggcacaaacgtataaatagccttaaaaacatttttttgagacaataatgcggccatatctgccagtacaggatgatagtataaatcgacaaagtttaattgtttatgtcgctcatccaagattctaacgcccaattccataatttgtagcgaggttgcccctaacattctaaagttactctgatagttaattgtatctggatcagcatcaagcacttcactccatgcattaatcagaaattgttcgttttccctttgagactttgacaaatgacggttatctttggttagagattgtcgcgaccattcctttatcattcgtcgttcatcaatttttccattaatatttaatgggaaacttgttagttgatgaatcccaatgggtatcataacgcttggtaaccgactagcaagtgcatttagtatttgagattcatcaatcgcttttgcactagttacccaacaataaatacaatttgctttcaccgctaaataacactgtttaaggttcggaataatttctcgacatacgctccccacttcgctcaaatcgattctcacaccattaatcttatattgactgtctcgacgaccacgatattccaattcaccgttgggtagtacttttgcgtaatctcccgttcgatagccccatatgttttgattttgatagctaacactggtaaaagctttatttgtggccttttcgtttaaaaaatacccattggttacttgaacaccataaataaacaactctccaacagatccatgcggtagcacacgttgttgatcatctaaaatcaaagcatgcatgttgcgaattggttttccaattgtcactgtctcaccaggtcttacacgacaaattgttgcacacgcacattcagtattaccataaacattcataatttgatagtttaattgaccaatgtctacatctggaaaacgctgccccgccaacgttaataaacgcatacttggtaacttcatggatcgcataatgatttcaccaatcatagttgaagcattcataaaagtgatcttattatcttgtaaatacttctctaatttatttaaatcatgccgctcagtttctcctaatacatacaatgttgatccagagtaaagactagaaaaaagatcatagtaactaactacgaatgagtatggagtaaaacttgctactctatcatccgtcgttaattgataatcttctttttgtgtttcaacagtatttgctactgttcgaaaaggaatctcaacgcccttaggattgccagttgaaccagaagtaaagtaaattgcccaggccgtagaatgattcttactactatttggtaccgtactaaaagtgtagtgatcatctttaagttcaattaaagtttctgcacctgcagtttcaaccattgcatctaatcttgctaatggttgcgcaatgtcctgaggaatgaaggtaattttcatcttagttagtgctaaaaccattactgtaaatttgactcctcgcggcaaacgcaagacaacaatttgatcattaagctgatttttttgcaacaactggctagtcctctcaacagctactctcaactcgctatatgttaactcgtcagaattatcaacaactgcaagactattaggtgtgatttccgcatatgataaaatcacatttaagacttcttctctattcatcttccacctcacatttaatgcttttctggcatatccagctcatcaccacaacccacaataatgaattatggttactaggtatctgtggaaaacttttcagagttttcagcatttctaaacttgttatgccatattcatcacgtgcaagtatactcgttagctgtggcctaattggaacctgtacattcaaatttaaaacacttgctattgtctccagttcatcatctttaattgtattggtcatattaactaatgcgctggttacatatgcctcttcagtattcacagaatgtttacttgctaacacacttgctaaatgtgcatgataaaatgtcctatgaaattcctgataaatatcatgcaaataatattttttgaccaaattttcattaaggtttccctgtaataccgaaaaatcttgcaaactgattgggttatattgttgctgccttacataggcaccatagcttcgtgataagtacggatgaacaatatacaagtcagagttccatagccatttcaaaaaataagaacaaccatcatcaagtgaaatctccaacgcagctaatagaccatccagataaggtggagttccgtttcgatcccatcttattttatctgctaaaaatacgattttaacgagatcacttgcacgatcaatacacgttgtatggaataaaatagcattcaacatatcttcatccgtaatatcaaatagggtttgagcaaaatactttcctaacttagcatgtactagtaacggtacttcacgttcctcatcattcaggctaacacctatagactcagccacggtcaccctttcatcagctggaacagcaccacctaaatcatgaagtgtcccagtcacaaacgccttgacggaatcaacatgaaacttacgtgccagcacatatgagatgtagcctaccccgtatgcatgcagataattttctgttacaggtgttagataccctcgccatttcatagttcttctgctaataatccatgcttttcataacgtactcgcttcgtcaatctattttcatcgtcgacaagtacaacatacggctttgcatgcttggcctcttctggctcaaattgcgcataattcataataataaccttatcgccaactgatgcacatcgagcagtagcaccgttcaagcaaatcacgcctgagtcccttggccccgcaatcacataagtttcaaaccgcgcgccattatttacatccgcaatttgaactttttcgtattccaagattccacttgcttccatcaatgtttcatcaatagtaatactaccaacatattccaaatcggcctgtgtaacggttgcccggtgaatcttaccttttaacatatcaattaacattactctatacctcctcggctacttaaatttcaccatctatattttcaatcatttgtttcaaaacatctttataaacaccagcaaacttttccactttacttcgtgtgaacaatgactgcgcataattaatatctatggtttgaccccagacaaaaattgcaagatcagtaaatgcatccttcacagtttcttgattcatttctggaatactcgtaaacagtgatgagtgcttaagcgcttctcgcttgaacccttgaataccgaaataagctctgtttcctgtaactgaaatattcaatttctccaatacagttggcagtggaatatcttggttgttctgagccgctatcatcttttcatctactatttttaacaaatcactaaatgtcttgatactatctaagtcaatcgtaataagaaactgattaatgaataatccaataagattctctactccggtaacatttcgaccaactgttggtactgcaatcgaaatcgcattgttcctagtaactctggacagaagcacaaagtacacagttagcagtagattatgcatagttgtaccctcgttgacaaccaacactttcaattcatgatataactcatcatcaagtcgaatatacacatcatcaccaagttgattactttcaatctgtgtctggtcaactggtaataacaaaggttggtagcaactaagttcatgttgccagtaatcaatttgtcttttagcctgtgtaccattcagaaaattctgctgacatttagcaaaatctttgtattgataaggaagttcaggcaaatccttccccctatagaatgcttcaatctcatctaagaagatacttgtagaccacccgtcaaatgcaatatgatcgatgacacaagtaaactcaccgttataaatattggctttaatcggaatttcctgttgaagattgaaaacatgactaaagtaccgattgcgatctatcttttcttgtttgacagtaaacggcgtatcatcaacaatctgaaaaccatcataaattttagaacgcaatatttgctgccgcttaacctccttttctatagcaattatcagacgttcaacatcaacatttggctttaatttgaatgcaatcttgacattcgtatatgaattagttggctctttttggtaagacgcttgtgccgaagataagcattgctcagttacatccttaaaagtctgctttgtcacagataatgacttttcagcatcgttgatgttcttatttgctaccaactctgcaatatttttcaaggtcttagccttaaaaatctcttttattgtgacttgctttccaaaatgatttttgagaatgctaatcaacttgataactttaatggaatcaccaccaatggtaaaaaagttctcgagcatggacgtattatctaacttcaacgtcagcaaatcacaaacaatctgttttacttgttcttctgttgaattctgtggctctacataaatcacaccattatcgtatgatatttcaggcaatgccctacgatcgatttttccattaatcgtgagaggaaactctgaaatatgttgatagccagaaggcatcatataatctgtcaaatactgtgaaataacacgttcgatgtccttacgtgctatttcttgattgctaacataatatacacccaaatacttactgccttctttacctagcgctaatgccaatacttgcttaacaccaggaacacgtaacatagcactttcaatctctccgagttcgatacggaatcctcgaattttgacctgaaaatcattacgaccaatcagttcaaattcaccatttgaaagtacacgaactatatcaccagtcttataaattcgactgtactcacttaagtgttgatcgttatatggattattcaagaaggcgtgctgtgttaattctggttgaccataataccctcgcgacaattgcggcccagaaatatacaactcaccaactgcaccttgaggcaataaacgctttttcctgtccaaaactaaatgcgtatagtttggaaatggctggccgatattcgaatagtttgattcaatacgtttcatagaagtccaaactgttccttcagtagggccgtaaatattaatgagattgatattatcgaatcgtttagcaaatgcagcgttcattttttcgccaccgaccataatcgttgttaagctagtgtttaatatttgtgaatcattatcctggaaaaagtaactaattcttccaggcgttgattgcaatgtagtgacatcatggctagccataaactgtgggaagtcttctggctcaccagcaaataagttaactgtcttcccacgtagtaactgaccgaacacctctgtcccaaaaatatcaaacacatattctgcaatacaaccaaattcgatattagtcgtaccagtctttttaattgcagccaagatatttgataagtaaattataaagtttcgatgttcaaccataacacctttaggctgaccagttgtgccagatgtaaagataatgtaggccaaatcatttggcttaactgccaaattaagattattttttagattgctaaatgattgagccatgaactcactatcaataactaattttgcttcaaccttctcaacgatatactttatgcgctccttaggaaatgtcactgccatcggaacgtaaactgcgcccgctttcaaaatcgccaaaatggcaataatggtattctcacttttaggcagcagtaacggtactcgatcacctagcttaatatcataatcttcaaccagcgtatgtgccaccctatttgctctttgatttaactcttcaaaggtataacggatattcttgaaatcaagggcaatattattaggatgttcacggacctgctgctcaaattcttcagcgatagtcttctcaggataataagcagtaccaaagtttggagccttttcaataaaggtaaagctattgactccctttacaatctgtgatactaaccgctgaaccatcgcaaataggtgatcaattgtcgcttccgcaaaaatttcaccagcaaacattaaactaaaacttaaactatctgataactctgacaacataacagttaagggataatctagtttttcttgtgcacgaaaattgtgcacctttagcatactgctcgaactatcagtagataccggatagttttcataaacaaacaatgtgtcaaataatcgcgttccatttctctgtaagccagccaaactgacattgctatgcatcatgcactcattattaatatcctgcaatttatgcaattgatagttaatcgacttatcagtgtgactaaattgaattggtagcgttcgaatatatagtcctacactatcttcaatcttttcaattggaatattacggccagcattaaccacaccaactgtcgttgaactaacccctccataaatgcttagtaatttatgccaagcatattgcaatacgatgcttgttgtaatgccattttcctttgtaaagcgtttcaactgacgatatagctcaccagaaattcggtataacttagttttgggatcagtaatacgtttaacttcttcaagcttaacttcatgtgcctgcaatttaaatagaccattcaaatcgggatgaacaggctccgaaagatttttctgccagtactcatcatctatatgttcaggctgagaaagatatcgttgtgcattcacgtaggctgagtcatcagaaaattctgtcaccttgtcttgcatcagattggcatacatagtatgcacataattcaaaagtaccggattggaccatccatcagagattgcatgatggttggtcaatacacaggtatattcattagcatcattcttaaccaaacaaactctgagcaagcttcccttcttcaaatcaaaccccataatccgttgattatggacaacgttctcaactgactcacctgttacgaagttaaaatcaaggtacccatgaatcggaatcacttgtagaagagttccgtattccgaacttaatgctaatctcaaactcggaaaatgatcctgtgccaatttccaagcacgtctatacatctgaacattaatcggttgatcataatcaaaaatatatgaacaaacataggcatcatcattagtatcattatttaatgattgataaataaagccctcttgcagcttatttgctggtaaaatcgtttgtaattcctgttcttgttgtaaactgtctaggttcttctttgaaatatcaacctcaatgtcctcaactgttaagtaagtccgttcagctgtagacaaatcctcaattaactttccaagttcagcgtaatattgcttagctaagaccgaaacctctgattgctttcccacaaattcaaatgataatttttgttcagatatggcaccattaatttgtaagaagtccgaagtcgatgcctgcttacccacaactgtgtcttctggaattacagaccatgggttcaactcaccattgtttaattgacctagataattaaatgtgattccaggcaacttatcatcatgaattccgaaacgttctccatagcccacaccataatctcttacttgagaagtataatgcttggtttccaataaatcagtcgaaattgtttgtggatacattgcggtaaaccaaccaactgttcgatgaacgtttaattgatctgagagctcggcacgcccatgagactctaatcttacataattgatatcagtttttgtgataaccttcaaagaacgtgcaagagctgtcaacaaaacgtcattaattttagtatggtaaattcgatttgcgcgctttaataatgcatccgttattttcctatcaaaactaactattactgtttggctttcaccttcttgttgaaaatcgttattatatttaccaatcgtaactggtttaaattccgagggatgttttttcgtatatgttatccattgtcgatagcttgttccctttgccggtaaaatagcatgattatacaaactattaagatcgtctgccagtatttgccaagaaacagtatcaattatcagatgatgacaaataactatcaatgtgttgtcttgttcatctaccacaaatcgatataagatcccattcaggtcaaaacttacttgtgaatcagtgagctgtgactccgccttcacaaactgaagttttactgactcaattttctttgaatacatttgcttttgaccatcaaagcgcatacgaagcacatcatggtagttaactaattccgttaacgctacttttagtcgtttgtaatccacattacttggtaatttaatcttaaatgcctgaataaaacgtgaagatttaacttcatcaaagaaccatttctggatagacgataactgaacttcaccagttagtgtgccttgttcacttatcagcttgtctactattttatgaccacataacattgccatatttcgtatgctctttgttgcaaaaatttgtttaattgttatcgtctgatgtaactgctgttcaattcggttactcagctgaattgcctttattgagtctcctcctaaacggaaaaaactttcagttacactaacctgactgacattgattcccagcacttccgcaaatatccgctgtaattcaaattcactttgagtctttggttcaataaaccctttttcattcaaggtaggcttaggtaatgcccggcggtccaatttaccattaaaagttaatggaaaagcatttaatttaacaaaagcgctcggcaccatataatccggtagagttgtcgatagttgttgcttaatactctcttcagaaagctgattaccggaaatatagtaggccaccagctgttgattaactgcaagtacgatagcttttgttatccccttgatttcaatcaatctagtctcaacttcacctaactcgatacgcagtccacgaactttgacttgcatatcatttcggcctagatattcaatatttccattgcttaataaacgaaccaaatcacccgttttataaattctacctaacttagcattgatcacaaatttttgtgctgttaattcgggttggttgatatagccacgggctaattgaacaccacccagtgctaattcaccgatggctcccacaggtaacaaatgatctgttcgacttaatacataacagttcgtatttgctacaggcttacctatcaataccttattcaaattatccttattacaatcaaaataagttacatcaatacttgcttcagtagggccatataaattaaataatctagttgctggcattaactttcggaaaagcttgacactattaatattcaacgcctcaccagaacagaaaacatacttgagcgacgtcaatttaaagtttggcaaagtatcgtcagagcgatacacatctaatgtctctaaaaaggcatccaacatacttggaacaaaatgcattaccgtaatgtttttattgtcgatttcattggcgagatatactggatccttatgaccaccttcaagtgcaaaaacaatccgtgcgccttcaaggagtgcccatacttgctcccacactgaaacatcaaagacaaaattagtcttttgatatacacgatctttttcagtgatcggataagtagcattcatccattgaattcgattacttagaccaccatgttcaatcatgacacctttgggtttaccagttgtaccagaagtaaaaataatatacgctaaatcagataattttggccgatactttggcgccaaggtagaacattctttagggataatataattatcatcaacaatcacttttgcattgatttgttttaagataaactgtttgcgttcttctgggaattccggagatactggaacatacgcacaccccgcctttaatactccccaaatggcaattgacattttttcgcttcgcttcataatcagtgggactttgtcccctggccggataccagcatttaacaagctattcgcgaacttattagtcaatttatcaaatgtttcatatgtcaattggatattctgatattcaattgcaacattttgcggtgtttttgctacttgttctttaaataattcaaccactgtttttttaggataatttactacatctccacgagccaccacgtcaacttttccaacattttgcataggaacattattctgtactaaaagtttttctagcaatgtcatgtacgtattaagcattgacgaaattgtagtttttttataaatatcactacaataattgaaactaatatatccgttttcaaccattacagaaagatcatatttggcagaatttcctgttaggccttggttaataccgctaaataaattactatttttaatttccttggaaaaatcttgtacactaaagagcacctgaaaaattgcatttcttgatgagtcacgctcaacattcaaagactttacaatctgctcaaaaggaatatcctgcatattctgaacaccctgaactttcaaagaattacttgaaagtaactctttgaatgattgctcttcatcaacctttgtacggataggcaacgtattgataaagaagccaatcaaatcttcagttccctcaatattacgattagccaatggcgtgccaacaataatgtcattttgataactaaaccttgataacattaggtctaatacactaagcattactgtatataaactagttttctgttttttagcaaaattaagtagttcatgctctagtttattattaaacggaacttgaagtgttttacctcggtaagtgaaattcttagggcgctcataatctgctggaagatttaacgtttcatatcctgacaattctttcttccaaaaatcaagctgttcttggacggcactcgaagcaacatactttcgttgccactgtgcaaaatccttatactgaacggtcaaagacactagtggttcttgataatacaattgatgtaattcacgtaagaatacttcagtagaccagccatcaaatgccatatgatgaatatcaataactaattttctggcataaagattgactcgaattggaatattctttgttagattgaacggtcgatttaggtactcgttcacatcaatacaatcatgggtaatttgtaattcttggttggttacaatctgataatcacctttgatgcatgtccgtaagatttcatgccgctgtacaagtgactttaacgcactctctatcttttcttttgatacatctttcttaagattcagtactaccggtacattatatgcactcaaattatcttcaaattgttctacaaaccataatcgttcttgcgcaaaggataatttctgatcggatactttttcaaaattccccttagttacgcgaacatagtttgatttcattttggccagttctcgaatgtttctcgaatcaaaaatttgtttcacttgtaaattgatatgattggctaattttaacgctaagatggaattaccaccaagttcataaaagtcgtccaaaactgaaactcgttcaagattcaataaaccacaaatttcttcagcaatttgtttttcccgtgcagttttaggtgcaacaaacttggcatgctcaatctccggctctggtaatttacgtaaatcaatcttgccattaatcgtcattggaaatttatccaaatgaacatagttacttggtaccatgtaagaaggtaactgtttttcaagagtatgttctagttttccttgataataagcaattagatttgtgccatggactctcactaaacaccgagtaatacttggctgctccatcaaccgcgcttcaatttcccccagttctacacgaaaaccacgaattttcacttgaaaatcatttcgtcctaaatagatgaaatcgccacttggtaattgtttaaccatatcccctgttctatacagcctacctaatcttggatgattaataaacgctttttcagtttttcctcgatcagaaatatatcctcttgcaacacctggcccaccaatacatagctcaccaatcgctccaattggaactactcgattttgattatctaatgcacatgcagtcatattttttaatgcttgcccaatattatttgagctcataccactttcgtattctttgacagttccaattaccgttacttctgtaggaccatacgcattaaacatctgagtatgattcttttcatacgccttatagatttcttcaggggtggactcacccgcaaccaccaatttattaactggaagtaaatcctcagcatttaatacagctggcggtaaaatcatcagactaattttatttttaatgacaaattgttttaacaactgataatctactctgattagattgtctaataaataaatattagcacccgtaagcaatccatagaacaattctagtacagacacatcaaacacaaaatttgcaaagtgagtcattcgcaatttactttgtgcccccaacaactgaatatgattataaatcgtattcactacaccacgctgttcgaccattactcccttcggcttaccggttgtaccagaagtaaatatgatatatgccaaagaatcagtaggaatattcagtgctaaattattgccatcatcagacgtaacttgaaattcatcatcaataactaaattggcatgaatcttatcaagtatataatcaactctttctttcggataatctaaacttagtggaacataatttgcaccagcttttaatacgcctaagattgcaataacaaatcgctcattccggggtaataaaattggaacatgcatccccggcttaattccctgatcaattaaagaatgtgccactttatttgctctgatattcaactcaccatatgttaattgatattgtttaaaattaattgcgacctgatcaggcgtcctcagaacctgttcttcaaacaaatttgctaaagacttctctggataattttcatgctgacacgcaatttcttgcatactaagttgaatagagtcaagtctcctacttggttcattagcaatttgttttaaaatcaactcataagtttttacgatattcagaatagtctcacgcttaaacagctttgtcgcataggttaagttcaagttgtttccacgatacgtcaacgaaaaatcaaacttactacttttcaatgataaattctggttcaaactattaaacagtgcgttctttcctatcaacgaatccatattatcttcaatactaaacataatttgaaagattggatttcgtgacatgtcctttttaatatgcaatgcttcaacaagttgctcaaatggtaagtcctgatttgcttgagaaatagctattttacgagtaacttttgacaaaaggtctgtgaatttaattccattatcaaatgttgttctgattgctaaactgttgacaaagaaacctatcatatcttcagttccctgaatatgtcgtcccgcgatgggagttcctacgacaacatcattctgattactatatgctgataatagtaaaataaatgcactaagcgctacgcaataaaaactcgtatcatgcatccttgcaacttgattcaactgttgaattaatccatcactcaaatgatagttcaattcatctcctgtataatcaaatctttgaggacgcacatagtcagttggaaaatcaattggtgaatatccattaagctccttcaaccaatagctacgctgtggttttagcatatcttgagtttgattgttaatctgccacttagcaaaatctttgtactgaactgtttttcgcggcaaatctttaccattatagagatccgttaattctgttaagaaaatgtcagttgaccaaccatcaaaagcgatatggtgaacattaattgctaactgattatggtatatattaatgcgaattggtatctcactagaaagatggaacttatacgcaaagaattcatcaatattaatcggttcatgcgtaattttgactggactggtcattacttgctgatatgatcctctaatcacagtacgcaaaacttcgtgccgctgtataacagtttgaatagacttctcgagtttgacatggtcaacattttcttgaaggtccaataacattggaatgttataggcattcgtccctccctctaactggtcaatgaagaaaagacgttcttgcgcaaacgaaaggttctgatcctcctcatgcaaaaatttttgcttactaattttttgaatactatcgtgctgcatagctaaatttgctactgtcttacaatcaaaaatagttttaacagagacattaatcatattagccagggaaatggcaataatcgaattaccacctagtctaaagaagttagcctttacagaaaccgaatttagattaagcactttagcaaaagcatctgcaatttccttttcacgccgatttcgtggtgctacatattcttcttgttgtaccggctcaggaagtgcccgtacatcaagtttgccattaatagttagtggaaaatcaagcatgtgcatatacatgctaggaaccatataatcagcaagtgattttgacagttgattatacaaatcatcagagtcgatactactttttgaaatgtaatatgcaattagatttccatcttttgcgataacttttgcctgttcaataccttcaactgcttgtaattgcttttcaatttcacccagttctacacgatatcctcgaattttaacttgaaaatctttccgaccaaaatattgaaacgaatcatcatataaccgtcgtaccaaatcaccggtatcataaataataccttttccaaatggattattgatataatgcttttctgtctcttcagctcgatttaaatagcctcgtgttacttgagctccaccgatatacaaattaccgacagctcctgctggtaacaattgtcgattatcatctagcacgtaggcatctacgccaccaatcgggcgtccaattgacaaatcatgtacatcattattggcaaagcttaagacagttgtttcagttggtccgtaacaattatttaactgaattggcgtatcagcatatttattaataacatctcgtgtaattgcttcaccgccacaataaatatattccaaactggatacacgatttaaatcaacacgagctgctaacgatggtgtcataccaatagcattaatctgatattgattcagtgtgctaatgaatttatcaatatcaaatatcaagtccgtatcaagtacaacaacactttctcctaatacaaaaggtcgaattaaatcatgtactgatgaatcaaatacatattcaaagaatgcaccatttttcattccctcatgcattccggaatttttcattctactaacttcaagtacataattactcaaattatgatgttcaaccatcacgcccttaggattcccactcgtgccagaagtaaaaatcaaatacgctaattgattttgttcaattctcatctggagattctcatcatctctgggaaaatcacgttccataaattgatcatcaattacaaattgggcgttacaagccttagtaataaaatttattcgttcactaggatatttcaaactaactggcacatatgctgcaccggctttcaataccgacaaaattgcgactaccatcttgtccgttcttcgcaacagcaatggaatcttttgttctgacttcacatcgagttttttaaccagataatttgcaactcggttaactcttctatttagttcagcataagtccattttttatcgtcaaactctaacgccaatgcattcggatgtttcataacctgctgttcaaaaagatcaataactgattcatgattatccgtcttaggaaaagtcaaaagttgatttttctcaatctgcgtaatcattgataatttcgagagtttattatttaagctttggacaaagttttccaacataattgttaaactatgcactaacatatctactgttggacgctcaaacaatgttgaatcatagttcaaatgtaattccatatcgttgtcattttcgaaaatttcaaaagtcaaagcaaactttgactctgttgtttcatatgagtccttaacagctggagcatcaaatcggtgatgcatatttttagtattctgaaaaacaaacatacaatcaaacattggattccctacatcactggttgcatgtaagtcgtgtacaatatcttcaaattgataattttgatgtgccaatgaggctaacaacgtctttttcatcatagccaaatattcaagaactgttaaatttggctttatattcacacgaacaggtaatgtattaataaacattcctagcatattctcagtggcagcatcaactcggccacttgcaacggttcctagaatgaaatcattgctgtggtatgtcttagaaagaaacgcacttagaacactaaataagatcatatactcgctactactagtttcatgtgccaaattgcgcaatttcgccaccatgtcagcgtcgaactttttatatacagtagtaccgactgccacatgatttttactccatggatagtctgttgctagttctaatcgttggtaatctattaactgacgattccaccactgtttgtcatcgcttacgtctaattcattaaaccattcactatagtctttgtactgaaattttaccgggtccaatttttctccacgatatagtttctctaattcagtataaaaaacagtctcgcttgttccatcagtaataatatgatgtttgtccacaaataacttatctactttttcacctttaatcagtcgaattcgcatcgtttctccggcttctaagtcaaacggctttactagctcttgataattacttatctctttatcaattactgtaaaatcaagctgattattagaaagtaccttttgcatgtagtgatcattttgacgataaaaagcagttcttaaaatctcatgccttaagacaagcgcttttaatgctcgctttaacctattttcgtctaatctcgtagaactatttagtacagtctgttcattataatcggtactatcatggttcagttcatataaaacaaacatccgcttttcagctggactcatttggaaaatgttacgtgacttactttgctggatagttgttaatttagattcattatacgtatctatgaacttagctaatttgcctaacggctggttattataaatgttttcagcagtgaggcgcttaccactaactgctacaatcgcatttgccagctgcatagcttgtaaagaattagcacccaattgaaagaaattatcgtttttcccaacatgatctacgttcagggctcgttcatatagttgagctaacgctttctcaatttcggtcttaggagcgacataacccacccgcctaatattaatatccggtaattttttacgatcaatcttaccattctcatttaacgggaacgctttcatccatttgtagtactctggttgcatataggaactgagtttgttcttcacagcgtctttaatagcgctttcattcaaaggcgcatcactcacgtaatacgcaattaaagtctgatttttgtaactagtaacaacaacatctctaatttccgcaactgtcaggagttgtgtctcaatttctgcaggctccgttctaataccattaatatttaactgaaagtctttgcgtcctatgaactcaaattcattattcggcaatttttttactaaatcaccagttgcgcacaaaacacctttgtcaaaaggattatcgataaagtgttcctgagtctccaattccaaattcaagtagccattagctagttgattaccactaaaacaaatctccccaatctgcccctcagtaacttcattcatcttgccatcaactacatatgcacgcattccatttacagggtgtccaattttattaatatcatcaactgtattaataatatttgtagtacctgcatgaaattccgattgtccataaacattcactaatgtaacttgattatcatgcgtgttcgtgaataacgatcgaggaatcttctcaccagcaactgcaacggtcttaacagaagtcagcctactgaaatcaatactattcgctaacgatggtgtacattgaaaataattgattttttcggtattaatatatctttcaagatgatcaatgtcctcaacagcattggaattggaaataacaagtgtatcaccgtgtaacaacgcaccgaatatctgagttgtcgctactgagaacacataattaaccaagaacagcatattataatgttcatcactcagaccaattgccttccagtaagaatcaatatggctggttacacttaagtttgaatgtaagactcctttaggatgtccggttgtaccagacgtgtatacaacatatgccagatcttggataccgtgtttacagtccggattactactatctgttcctactaatgcctgactcaacaatttatcatcaacaataatagcagcattcgtttgttcacgaataaaatcaatacgattttgtgggtattgctttgataatgctgtatatgctgcaccagcttttaatactgctataattgcaacaatcatattttcgctacggtcaagaagtaatgggacaatatcaccgtgtttcacttgacagtttttaatcaaataattagctacaatattagattttttatcaagttgtcgatagtttaactttttctgaccaaaaacaactgcattctgctctggtaccttttctacctgctcttcaaatcgtgtaataatagtattgagcatcaaatatcatcctttctacaaaaaaatagatggcctcacgaatgagtccatctaaatctatcaacgagcttcactataaattaaaagttcagattgaagtccccaatattatgttaacaatagctttttacattacaccaagaacatgcataacaacaccaaaggcgaagaggccgaagatgataataattggtgaaactttcttctttagtaaccacattgacaagaaggtgattaataaggcagctaatcctggaattaattgatttaagttatcttgtaaagtcgtaactttatacttatcgagcgaacgaccagcagcttgttgcgttaaggcttccttgataccagcagcgccctttggtaatttatcccaatcaatataagcaccggcactttgcttgattcgtgaaactttaactggactgaaatcaacaacaacccaccgttcaatcaaagcaggtaagatgaacatacctagaattgatgcacctttagtgatgtcttgtaaaataccaccagataaatcttcagtaatcttagaaccagctttgtacccgaattcctgtgtgtaccacatgaatcctaaacgaagtacgttccatacaacgaagtataggattggacccatgatactaccgcccaaagcaagagaagcagctaaggcaccaataattggcttcaacgtgaaccagaacactggatcaccaacaccagctaaaggacccatcataccaactttaaccccttgaatcgtaacatcatcaattggagcaccattggcacgttcttcttccaacgccatcgtgacaccaatgattggtgaggcaacgtatggatgagtgttaaagaattccaaatgacgctttaaagctgcggcacggtcttctttagttgtatataactttttaagtactgggattaaagtaaatgcccagccaccattttgcatacgttcgtagttccatgaaccttgaaggaagttagaacgcatccaaaccttaatacgatcacttttagtaatttgtactttattatcagccattttctttccctccttcgttagtatttatcgataatatcgccgacagggtcaccagtgttagagccaccgccattaccagaaccgcccatcttagaaaggttcaagtaaataagagccatggcaacaccaattgcaccaagtccgataagtgtaatttcactaacagcagctaatacgaaacctaaggcaaagaatggccacatttcgcgagaagccatcatgttgataaccattgcgtaaccaacggcaacaaccataccaccaccgattgataaaccatcagttaaccatgcaggcatagcattcaacattgacttaacagggccagcaccaacggctagaatcaaagcagctggaatggcaatccgtaaaccttgcatacaaattgcaagaacatgccagaattcaagttttccaaaactaccttcttcagcagcacggtccatgatatgaacaatgatagttgctaaagtacgtgcaagaatggttaagagtaaaccagcaacggccaaaggaacggcaattgcaatggctgaagaaactccggcacggccttgaccacctaaaactaagataattgcggatgcaatggcagctaaagcggcatcaggagcaacagcggcaccaacgtttgaccaacctaacgcgatcatttgtaggctaccacctaaaataatacatggtactaattgaccagtaactaatccgatcagcgcacatgcaacaactggttgatggaaatggaattcatccaaaataccttccataccagctaaaaatgcaacgagtacgactaaaatcatttgaattgcattcaaattcatgatttaatcctccattttcttctgatagttatctatactacttttgttcatttaacatgttttgagcctttttaagaatattatccatattatccttactatctgaaggaactttacgaacatcaaattcgacgccgtcttgttccaacttcttgtaagtatcaatatcatcttgatcaaaagccaaaactttgtttggttgaactttaccaactgagtgcgccattgaaccaatgttcaaggtcttaattggcacgccaccctcgattgcacgtaatgcatcttgtggcgtttcgaataagaccaacgccttttgaccaccaaagtgcttgtcgtctttagcaatcttaatcatttgatcaattggaataacatgagcatgtacgcctgctggagcagcttgcttaatcatgtttgaacgtaaatcatccttagcaacactatcggaaacaacaatgatccgagttgggttaactgtcttactccaagcagtagcaacttgtccatgcaagagtcgcgagtcaatccgtgctaacccatattccaacttccctggccggccagcgttattgttggtcgttgcagcggcagcagccttttcttccttaggtgctaatgcttcaggacgaacctttacgccatccttagcagtttcaatgatatgcgtggcaatttcgtgtgccgaatccattgaaagtcgtgaagcatacgcttcaattaacattggcaagttcaaaccggcaacgattgcccatttgtccttgtgtgcttcaaacaagccgttaacttgattgaatggtgtaccgccccaaaggtcgactaagaataagacttgctcttgatcgtcgaatgaagcaatggctttttccaacttagccttgatgtcgtcagggccttcgctaggcatcaacgtaacggcttgaacgttttcttgttcgccgaaaatcattgatccagattgatagatgcctttagcgaattcgccgtgactagcaatgataatgcttaccatctttgtacctcctattttttcgttacagtcatataaaacgaataaataatatctaaattgcctgtaactatttatgtttttgatactgtaagcgcaatctttttcgcactcacttatatatatgcaaattccgtgccaaaatacactaaagctaaaagcccttatttcaggctagaagttgatacactagtgtgatacagtattaaaaacgattattttgtgtgtcaaatagcgtatttttaatataaaattatgaaacagtaactaatgttaactatggtatcaatttcttaatagctcagcgcccgacgaccatttaattgccacatcgtctcaaacgcttggttatccatctgtccggattgaccacgccaaggatcattgtacctaatagttgccgttgtatatccagtgagcgtcactgtatgactcgcaaaaccatcgagtccctgaacccaagcgactaccggatgacgtttagtgagctgtgctttaagtcgttgcaggcccaccccgctgagatctacagcggacggcagatagtggcggatcgttggtaacaagccttgggggtagatgtagagaccaataccgtaagccgaagcaggatcaccaacaaaaccagtgttaggattcgaactgcgtggcacgtggctggcaaactgttccttattaatattaacgccggcatactgcagcatcatggtagtcgctgtcatctcacaccccgttggcaactccggtagctggtcaatcagtggtacccgcagttgaaccgacgccgtactggcgggttttagctgattagcagctatccagccgctctgctgatgaccattatgcacgtagtagaagcgctggtaatgcccgttgcgataaatatcagcttgctcagtacgcgtccactgtgtatgctggtgatactttaaatgtaaattaacacgcaattgggcacgctgatgacgcacgacggttaaatggtaaccgacaccgttctgactattcgtctgatagacccgcggctgcaccacctgaatccctgtaatcggataagtcgttacggccgcttgtgcggggtaaaccacgccactaacaagcactccgcccaccaagatacgccaccaccatctactcattctaatcaatgcctggtcctcgccttctcttaatatcgtaatcagtagattaaccgttttcattataatgctggtaatcatgagattaaacaataaggtacggcaaatttggtgaacatagttgaagtagttggcaaaaaagcaagcctgaaataacatgaccagtccaatttaccgcaaaaaacatcgatccatcaagctgaccctaatcatcatattgacaatgaagaagctaagtacattagcagttaccttcatgatagaatttaaaaatgacactgaactatatggtgcctaccacgagttgtcttgaaacaggtcgaggtcatagatgagtaaaggttcatcagaattttataagatcatgtatcacgttcacggttactatttaaatagatggagtaaatacttattagcgacagacgtaaactggtttggtgacaacatgttgaaaaaaggtacagaacataaagaagtcggcattaagaaaaaaattataggtaaaaaaagcagcgctgtccccgacataactgggacttaggctgctttttaatgatagttccgtaaatggtaaaacctacgagatagcgtatgaaattactttggtagcagagttccattcaattatcagtcctttaccagcttgggtcaccgctgtacaagcggatgaacacaacacctcagtggaggatgcgaaagcaaatacacctgaaatcacaactgtgttactgcgtgttggtactgccgcagttgtggctctcgcaataactagtttaataatgacagctacatttttaccgtcgattatccccggattaattaccttagctgctgcgtaataatgtaaaatgctatatggttagacaaaacgattggagtcatccgatcgttttttatataaaaattaggagtggtaaataatatggacacaacacaatttttattttttgtatggattatgtttttggcaattttcattctgagcttgctctttgcactctttacaccaaaggcattcacttacacatcacaaaatccaaaatctaaacaactaatccgtaagatactgataactaaaccaattagagaatatcggcgacagttaaaaataagtatcctctttagtacgctgggactaatagtaatgtggattggaattattttatttgcgttcaagtttgtgattgtctcactttttttacttgccattgcatcagcatcatatatttttatcggggttgtcactccttactatgaatataagtactggtcaagagcagaaaaaaaagaatttgggacgctgccacataaatcctttataaaattaatgacatgtcgaacaatatgtacgataactttgactcttttatttttactaccagcaattttcaactctgaattttatgatatcttatttaacattttttcttaaatcaaactattccggagccgaacaaatgcacaattaaggtcgattctacgtttgaacatgaatcaacaaatggtaaaacctacgagatagcgtatgaagttactttggtagcagagttccattcaattcctttaccagcttgggtcaccgcagtaccagcggatgcctttttgactatgctgctaattgataaacgccgcgggttacatgatcaaaataatctgattgttgcaaagtctggcgaatcttagcttgccaattacgattattgttagccttacgacaaccatcgagtagttgataaatagcgtttaaatctgtagctccgcctagagtttcaagcgctacttttacgaggcgcgcccaggtcacacggaaaagttgacagagaatcaataaaaaagccgatatatcaacgatttctcgtatcaatatcggctattctgtatataaaatgcggccaagaagattcgaacttccaccgggttaaccccgacaagatccttaatcttgcgcgtctgccaattccgccatggccgcatcacaactcacaaaaaatatcataacaaaattttgcgagtctgacaagcttattttaagatttttgtacttttacaccagttgcatccattggcaataagaataattggccggtgagtgttgtatcttggctcaattgtgcctgcaacgtagcgagttgaccgtaatcacccaaagtaatcaccgtcggcccagcaccactcaaataagtccccgttaatcccagagcatgggcatggtctctaaccgtttgtagtgccggcactaacttagcccgatactgttcatggaactggtcctgttctagcagtggtaacgccacgtcccaattttgagttgctagagcagccactaacgtatttgccacactactaccagtaacggcttggtggtacgccaattcagttggcaaggcttggcgactggcggtcgtcaatagcggttcgttaggcacgtagacacttgcaaaaagcatcggtaacggtaacttcaccgcacggacgcgtccatcagtgttcgtcgccacaaccaagcctcctaatagggctggtgcaacgttatctggatgaccctccagttgagtggcaacttccagtagctcagcagaagagcgcgttgcgccggtcaattcgtttgccagcactaagccggctacgatggccgtcgagctactacccaatccgcgcgctaacgggatttttgaagccatctgtaaatgctgtggttgtaaatctggtaccaaatgcaacgccgttttaataattaagttgcgttcatccgtcggcacatccgccccaaagggatggtcaatctgccaatggtcactaggttgcaacacttgtagcgttagttgcatgtccagcgccagaccgattgaatcaaaaccgggaccaagattagcggaagtcgccggaaccgaaatcgttaacatgtcctcacctacgcattctttaaaactttataactcgctaatagttgcatattctcttgttcaccgatttcacgagtgatatctgctaactgttgatcattcatggcatgggtaatgatcacaacacgagcgttgccgtcacctaattgattttgaatgattcgactaaatgaaacttctgcgcgggtcataatcgccgtcaatttcatcatcatccccggcacatcacgcatcttcaaggcaataaagtgaggatacacaacatcttcaggcgttgctaagactgtctcctggcgataagagttaaacgtgttaccagtcgtattcaacgcaatatttttcgcaaccgttgtaatatcactcagcacactgttggcggtcgggagttctccagcgccaggaccgtaaaacatcgtgttccccacagccgttcccgttaccattacagcattattttcattttgtaccgtggcaagtggatgctgatcagaaacaagcacaggcccgactgagaccgcaatgcgatcgtcaatttcttccgcaatcccgagtaatttaattgtatacccaagctggtgagcttccgcaatatcctctgggctgattttcgtaattccctgaacttgaacgtggtcgagggaaagactcatcccaaaggcaaactgcgttaaaataatcatcttgaacgccgcatcaaggccttcgacatcattagtgggatcactttcggcaaaccccaagtcttgtgctgagctcaaggcttgatcatacgaccaatgcttagtcagcatctgcgtcatgatgtaattagtggtcccgttgacgattcccatgacccgttgaatccggtcagcggcgaaactattatcaatcgtccgtaaaattggaatcccaccagcaacactagcttcatagaataagtcgcgatgattttcacgagcaatctgaaccaactcccggccatattgcgcaatcaagtccttattggccgtcaccacgtgtttgccagcttgcaaggcttgcgtaatatattccttcgccggatgaattgaacccatcacttcgaccataatttgaatggacggatcatcaagcagggtcgcgatttggtcggtcatctgaacgtcccccaaatcaacttgttcgtgctttttcaagttgtggacaactacgcaggctagttccaacttacgaccggtaatttctgaaatcttttcctgatgcgcttgaagcatttttacaacgccggtcccgactgtgcctagtccgaccacaccaattttaatcgtttccatcttaatccctccatatcaatagttaagctaattctatcggatgcgtaccactttagcaaaccttttcagactaatttaattggcccctgacaacgaccacacgtatagcggcgagtgtccatgcggcgcttgcggtaataccgctggccacaccgttggcattcataaatataccgatacggccgggccgtcgcctgcttcggcgctggtgcatagcgcgagccacccacttgcgcgagtaatcgtttaaagtctgcatcacgatgccgatatccccgcttagtcacatgtaaatgataatggcacaattcatgcttgatgacgccaatcaaggtggcctcatcaaaatcagtcagcatcttcggattgatatcaatatcatgcgaggccaactgataacgaccacccgtcgttcgtaaccgagcattaaaataagcgcggtgctggaacggacggtgaaaatcacgcatggaaatggtcgcaacgagctgctgtaactctaaatcagtcattatgcttcagccggtgcaatcatcgtcaaagcgatgcgctgccgctgttcatcaactgcttcgacccacaccgttacgatgtcgccaactgccaccgcctgacgcggatctttcaagaacttatccgttagtttggagacatgtacgaggccatcttgcttgacaccaatatccacaaacgccccaaagtcgaccacgttgcgtacggttccttgcaactgcatccctggttttagatcactcatctttaaaacgtcttgccggagtaacggtgcgggcatcgtatcacgaacatcacgcccgggcttttgcaaactactaataatatcctttaaggtcagttcaccgacaccggtgctggtcgcaagttgcgctaaatctaattgattcaactgttgggctttagtcgtcccaacgtccgtcgtcttcaatccagccgctgccaataacgctttggctgcgggataactttctggatgaatatccgtgttatcaaaaacattcttgccgtcaatgattcgcaggaagccgaccgcttgttcataagctttcggtcccaaccgcggcacttttttcaattgtggtcggctcgtgaattcgccattttcatcccgataagtaatcacattttgggcaatcgtgctggatagccccgaaatatgcgtcaatagctccgaactagcggtattcaaattgaccccaacttggttaaccgcggtctcaatcaccgtatctagctgcgttgtcaattccttctggggcacatcgtgttggtattgccccactcccactgacttcggatcgattttgatcaattctgccagtgggtcttgtagtcgccggccgatactaatcgcactacgttgttcaacgtgtagctcaggaaattcggcgcgcgccttagcactagcagagtacacggaagccccggcttcgttcacgatgacataataaaccggtcgggtcatagtcttcaatacctgtgccacaaactcctcggattcgcgggaagccgtcccgttaccaatcgcaatcatttcaacatgatacttctccaaaaaggctttaaactcacccgcagcagcttcccgtttggcagttggagctggtttgtgtggataaatcacgagcttatctaagaacttaccattcgcgtccatcacggctaatttacaccccgtccggtaagcagggtcgaaccctaataccacgcgaccttttaatggtgcctgcattaataagtggtacaaattatcgccaaagactttgatggcctgttcattggcagccgcactcaattcattgcgaagttcacgttcgatggctgggccaataaagcgtttgtaggcatcctgataagcagcttctactagttcaatcgctgggccgtggtgctgaccaataaagcgaaaatgacaataccggtcaattccagcacgatcaacatcaatgctgactttcaatactttttcggcttccccacggttgatagccagtacccggtacggtaccatctgcttgatgggactattaaaatcataatactgttggtaaacaccttgttcatcggctgctttacccttgggtttcacttttgcgactagtaagccccggtcacgcgtataattccggacccagtttcgtaaaccggcattatcaccaaaggcctcagccaagatttcgtgagctccagctaacgcggtattcgcgtctgtgatgtcctgcgcttcgttcacaaactgcgccgcgtgttcctgaataccacttgccggaaaacgtaataaccaagctgctaacggctccagtccagcatctttcgcaatcgttgccttcgtacgtcgcttctgtttgtacggtaagtacaaatcttcgacatcttgcaacttgtcagctttttcaatggcttgctttaaagccggcgtcaagtgatcttgttcagcgatcaacttcatcacatctgccttacgactctctagactcgcaagccgatcatagttatctttaatttcgcgaatttcaacttcatctaagttaccggtacgttcctttcgataccgtgcgataaacggaacggtgttgccttcgtccatgagtccgagaaccgctttgatctgttgcggtttaaacttcgtcagcgtttgattgactaacgttaaaatctgattatccattatttcacccaatcttttaatctcattacattatattatacgcgttttacccaagtttccgcgccgaatgaccatctgaaaattgtcgttgactgtcactaccaatcgaagccattaccgatactgttcacacattggttgtgagctggaaaaaaccagcccattaggctaaacgagcacggcgcggccgcacagttggctgccccgcaaccaacaataaaacgctcggcaacgcataaacgttaccgagcgttttattagtgtgctaaatccaatcacccagattagcgctcctacatgactgtattcatgatccgttgcacgttatttgaaacgcggcccatttcagtctcttgatccgtttcagcctgattaaaagcagccacatcaatcgtttgattgtcgatgttcatgctagccgtcatggccgcacacgcattcgtgtaggcttcgtatgctgctaacaaattacggtgccgccccattaaccgtgcgggtaccgcaacttttttcaactgtgccaaattttgttgatactgttcagtaccatcgctaaattccatctgaatatcattgaattcagctggaaccattttggcaactgcgtcattatcaatggcctgacgtagtttttcaaaagatgggtttaattcttcccccattttttcagtactttcgataactttagacagtactggcatatacgtttgaatcattgcttttttcatgtacaaactcttttctttaaattagttagccttattttacccctaatggatgggttatgcgcgccgcatgtgtcgacgttggaagaacttaacaatttcaacaatcacgaccatcgataaggaagctaaggccacgattccccattggtaagcatccaagtgactcacgtggaataacccattcagaccgggaacgacgattgtcatcgccagcatcacaaatgcaattagaatcgcccaattaaagaacttgtttcggaacaagccgaccgtaaacaacgattcatgaatggatttagaattaaacgcgtggaacaactgaatcaagccaagggtcgcgaaagccatcgttaacgcatcagcatgagctaatgaggccgttgcgtgaaccggatacgtcaaagctaaccagtacacgagcaacgtaatgccaccttccagtagcccttgataaataatactgctgaagaccccacctgagaagaaattagaatttctcccgcgcggtttatgctgcataatgttcttttcagttggttcaacgcctaaggcaattgctggcaaggtatcggtcactaaattgatccataagatatgcactggtgccaagatttgccagcccaacatcgtcatcacgaacaaggttaagacttcccctaagtttgctgacaaaaggtactgaatcgccttttgaatattggcgaacacttttcggccttcctcgacagcaaccacgatcgtggcgaagttatcatcagccaagaccatgtcactagcccccttggaaacttccgtcccagtgattcccataccaataccgatatcagcagccttcaaggcgggcgcatcgttgaccccatcaccagtcatagcaacaactttgcctcgtttttgccatgcgttcacgattcgaactttgtgttcaggcgccacccgggcatacaccgagtaatcgccgacctttttgctgaattccgcatcactcattgcatctaactcggcaccagtaatcacagcgtcatcttcgccagcgttaatgataccaagacggacggcaattgcttcggcggtatcacggtggtcacccgtgatcatcaacggccgaattccagctgatttagcttctgcaacggcttgttcaacttctggccgttctggatcaatcatgccgaccatcccggcaaagaccaggtcattttctaacgtctccgtattaacagtcgtcggaaccgtggtgatcactttataagcaaatgctaagacccgtaaggcttgcgttgccaattcatgattaacagttagaatctggtcacggcttgtcttggttaacggctgaacgtcaccgttactttcaatctgagtgacccgtttgagtaattcatcaggagcccccttgacggctactaagaagcgaccatcttctaaggggtgcaccgtcgacatcaatttacgttccgaatcaaaggggacttctgttactcgggggcggtccgtcaataactgatcgactggataaccctgatccaaattatattgaatcaacgctgtttccgttgggtcacctgctaacccatccggcatgatcttcgtatcattacttaaaatcatcacttgcgctaaatggctatcaagcggcaattcagtagcgcgcgcgtccaccagttcctggttgacgaccaacttttcaacggtcattttgttttgcgtcaacgttccggtcttatcagaggcaataatatcggtacttcccaacgtttcaactgcgggtaattttcgtactaacgcatgccgtttggccatccgctgggttcctaacgctaacgtgatcgtaacgattgccggcaacccttctggaattgcggctacggctaacgaaatcgccgtcaataacatgttgatcaaactctcttgaccacgcagcattccgataccaaataccactgcggcaataactaagattaaaatcgtcagcgacttacctaactgtgtcaagttcgcttgcagtggtgtggtcgtctcatcggccgcttcaatcatgccggcaattcgacctacttcggtctgcatcccagtcgccaccacaatcccagtggcccgaccatacgtcacgttactattcatgtacgccatgtttaaccggtccccgattggtaattctccatcggcaatcatctccgcctgcttctcaactgggacagattcacccgtcagcgccgattcttcaaccttcaatgacgcactctcaattaatcgtaaatccgcgggaacgatatccccggcttctagcgacacaacatccccaggaaccaacgcgtcactcttgaccgtttgcagctgaccatcccgtaaaacagtcgcgtccggcgctgacatttccttcaacgcgttgatggcctcttccgctttcgattcctggaagacaccgaaaatcgcatttaataccaccaccaataagatgataacggcatcgacggcttccccagtaaaggcggcaatcaaggcggccactaacaggacgataatcatgaaatccttgaactgcgcaataaatttttgcaacaaggaagtcgttttttgctgattcaacgcattcggcccatattgttctaaccgttgcgacgcagcactttgctgtaagccgtgttcatcagtgcctagttcctcataaacggcggataacgcttgttgatactttggttttgtactcatcgtaagctccttttctggcatccgagccccactccctaactgatctccagatagaaaatgagactcatgtatgcacgcaaaattgtgtgaacatacataagtctcactatttaagacaataccggattggcttcttgctgacgatattgccgcagaatatttctgctagttactcccttatgattgtatcgtaagaataccagattccatgggagctgtctagcaaaataatcgctttgactacctctgcattcgccacagcacttggatattctcacattaagcgtttacatattttaaaccattctaccgcttttccaccaatcccaccaatattacggtagtcaccataaaattatgtgactatgcaaaaaggcgacctgaagctgaataatcttcaagtcgcctttttaatcaggttagccgtaatcctaatcgattatcagctaactagcttatttccaaaaatcatcaaacacagtgatggccgcgtggcgtttgtgggcagtctttaagtaccacgcctcaatcttttcggccgcagcatcgctgaccgtccggccttccaagtaatcgtcgatgtcgtcgtaacgaacacctaacgcgacttcatcaggtaatgctggccgatcttcttccaagtcagcggtcgggactttgtcatacaaatgcttgggcgcatccaaagcggccagcatctgtttaccttgacgtttgttcaatcgccatagtggcacaatatccgcaccaccgtcaccgtacttggtataaaaaccagtaacagcttcggctgcatggtcggttcccacgacagcgccgtgcatttcaccagcaatcccatattgcacgatcatgcgttggcgcgctttaatattgcccttgttgaaatcatgaatcgtcaattggttagcttccaatgcagttaccatggcatccgtagccggttgaatatccacccgatccgtcacgtcggcttgcataaaatcaatcgctgccatcgcatccgcttcatccgcttgattgccatatggtaaccggactgcgatgaattgatagcgatcatcacccgtttcctgccgcatttcggtaatggccatctccgtcaattttccagctaacgtggaatcttgaccgccagagatgccaagcacataggtcttcaaaaaggtatttttagttaaataagccttcaaaaaatcaatacttcgacgaatctcaacttctggatcaatcgttggtgtaacgtgtaacgctttaataatctcagcttgtaatggccgcattagtaagcttcctcctcatctttatggttaacgtggtctctgaccgtgttaataatattcattttatgatcataaagtttttgtgacaagtcgaccgggtaatcctgagggtttaaatcccgcttgtattcgtcccaaagtgcatctagactttcaaatgaatactccttgatttcatctaacgttggtaaagtataaacttgttgaccgcggtcatagatgggaaccaatagtggtcgagcatcaaaatcgctgaccgtcttattaatatacgtatagcttggatggaacatgtaaattgattcttcgttgcgcggatcttcatcgtacaacgtcacatagtcaccttccgacttgccatccgcacgcttcgtaatccgccaaacttgtttttgaccaggcgttgagaccttttccgcgttatttgaaagtttgatcgtatcaaccatctgatgatgatcattctcgatcgaaaccatcttgtatacggcccctaacgcgggttggtcaaaggccgtgattagcttcgtcccaacaccccagacactaatttttgcaccttgcatcttcaagttttggatcgttttttcgtccaaatcatttgacgcataaatcttggcatccggaaaaccagcttcgtctagctgttcacgcacgcgttttgataagtaagccatatcgccactatcgatacgaaccccttggaaattgattttatcacccatttccttagccactcgaatcgcactcggcaccccgctacgtaacgtatcatacgtatccactagaaagacacagtcatgatgggtctccgcataggccttgaaagcttgataatcgtttcgataagtctgcacgagcgcatgcgcatgggtcccgctaatcggaataccaaaaattttgccagcccgcacgttactcgtcgcgtcaaagccaccaatataagccgcccgggttccccagatggccgcatcaaactcctgcgcccgccgagtaccgaattctagtaagccatcttcaccgacaaccgatttaatgcgcgccgctttagtcgcaatcagcgtttgataattgataatattgagtagtgccgtttcaattaactgacaagtggccagtggtccttcgacttgtaacaacggttcattattaaagaccaagtccccttcacgaaccgcacgaatcgtcgcatcaaatttgaaattcgctaaataatctagaaaaccgtctgagtagccacccagttcacgtaaatacgcgatgtcagttgccgtaaaatgtaaatgattgatataattaacaactcgttccagacccgcaaataccgcgtacccattttggaacggcatcttacgaaagaacacttcaaacaccgcatgtttgttgtgaataccttgttcccagtaggtttggatcatattaatttgataagcatccgtatgcaaggtaaaactatcatccggatagatttgcgtcatgagtataattctccatttcgtaggtaataaccgtgtttacagtaagttaagcttattttagcattttttataaaagaatgcgcttaagcatccaaaaagttgcagaattccttgatttacctatactttaattatgattagaaagtgaggtcacttatgtcagtcccttttgacacggttaacatcttaaacgtgccgtttatcaagacaactaacgctggttttgttcagcaacttcaaaccgatattctcgcgcatcacaatcgctttgtggtgaccgctaaccccgagatcttaatgtacgctcgtgaacaccccgattaccaacaggtgttaacacaagcggactatatcacgccagacggcattggcgtcattcagggggcccagattcttggcacaccactccccgaacggatcaccggctatgacacccttttaacactactagaatggggtagccaacagcaccaacggatctttttgttaggtgccaagccggccgtgttaaagcaagtgaccacgatcgttcaacgagattatcccggcatcgttgtcgcgggtgcccgtgatggctattatgacgacgaacaaaccattgtcgaccaaatcgtggccgcgcaacccgatatggtcttcgtagccactggttttcctaagcaggaatttttcatcgctgaacaccgccaacgcctcgatgcgctctggatgggtgtcgggggtagcttcgacgtaattgcaggcgcggttaagcgggcgccgttattttggcaaaaacaccacgttgaatggctctaccgtctgattcaagaaccaagtcgtttcaagcggatgctcgtgttaccccgctacttgcggttagttaaaaaaatagcgcgccagcaagcccattaactggcaatcattaccagttataagccactgcgttacgatgacaattgcttttgtgcgtgtacccagtcttcagtcatgaattcaaaaatagctcacctagaataacatcctaggtgagctatttttggtatcaccactctaatcaggtgcccagcacccgaccgactggttatttttcaagataaaactcaaaccggttaccaacgtactgggtccgcacgtattcaaacggttcgccggtttgcaaatacgaaatctgccgtaaccgtagcaacgcatcgccacgccggactgacaagtattccgcgatacgctcagaagcagacatcgccgaaaccgtctgttgagccttaccaggcactaaacttgccttctcttccaacgtccgatacaacgaactcgtaatttcgtccttggtgaactgcttgacgagtcgttctggaactgttgcgacctcaaaacaaattggcacatcatcaccatagcgaattcgttccatccgtagaacttgttcgttggcgcctaacgccaacttttcgctctcagatagcgacgggctcgtcacgtgatatgaaatcgtcttacttgatgggaccttaccctgggccagcattagatcagtaaaactggtgacaccggacattttttcttggaccttctgattcgcgacaaacgtgccggcaccgactcgccgctctaatattccttcgtcaaccaatgtctggattgcttgtcgaagggtcatccgactaacatcgaactgtgtagccagctcccgctcagacggaatccggtcaccaacggcccaccgacctgcttcaatcgcctgcttaatttggttgtggatttgaatataaattggcgaactcatggtactcatcccttacttctaatttatttagctgcttttttaccgtagctatatgttgcgactaaatcttgattgccatctaagatgttgatatcagcatctttaccggcttccaatgttcctttcttagtcaacccaaattcacgtgcttggttgacagaagccatcttaaccgcttcagcaatgccgcaaccggtgaacttctgaatattcttgaaggcattaatgaatgtcaggacagaaccagccaagttaccttcttcaagacgtgcttgaccatccttaacaatcactttttgaccacctaattcactgataccgtcgggttcacccttggcacgcattgaatcagtcaccaattcgatccggtcaacgcccttttgttcgtaagcgagcttgatcatgtcaggcacgatatggaacccatcacagatcaattcacagtacatgttgttttcaagcatggcatgaccagtaacacctggttcacggtgcttgaattcacgttgcgcgttgtataaatgcgtcacgtgagttgctttacttgctaataattgttcacgagtcgcgttactgtggcccactgaaggcacaatgccattttccaagcagtacttttcaaattcacgcgaaccaggatcttccggcgcgtaagtaatcaacttaacccgaccacccgacaacttgttccagttgtctaataagtcaacgttaggattcttaatgtacttttcaggttgggcacccttaaacgtcgccgaaatgaatgggccttccaaatgaaccccttggataaccggattttcatcggcggccttgttaataccggccatcgaatgatctaagttttcgttggattgcgtcatggtcgtacagaagtatgacgtaataccttcgcgggcaaccatatcattaaccatttcgttaatttcagctggattcccgtccattgaatcaaaactataaccaccatggctatgaacatcaatgaagcccggtacaatcgttttgccactcacaaattcgatatcatcatcgggttgggccacgtagtcatccattggaccaaccgcttcaatttccttaccgaaacgaatgtagccgtcatcgatcttttctagaccagtataaatgatggcatgttttaacactttgctcatgaacaattcctccttggatttatctggtttaattataatcggtatagaccaaacttgcaaccaccagcaccaagtaatttaagattcgccaagttccttcgcaatcgtcgcatcaattcccttcaccactgcggtcataaagccggcctcttccatggccagtaatccagcaaccgtcgtgccaccaggtgaagaaacttgatcgatcaggtcaaacggaattttatcagaagctaaaacattctgcgcactgcccagcgtggcctgcgccgcaatcttagtcgctgcatccttgctcaaaccgtgcttgacgcctgcgcgggccatcgcgtcaataaagaaatagatgtaggccggcgaactacctgctaaggctgaaaaagttggaaaatctttctcagcgatggcactcgtggcaccaatcgcatcgaataattgttgcccagccgcatattgctctggtgttaaggcatcattaccaaccaacgccgtcatcccggcaccaatcgccacgttcacattcggcatgattctcagaacggggagatcagggacaaccgtggcataatcggccaaactcaatcctgataccattgtaataacccacttgcccgttaaagctgcttgaacttcttttaatgcggccaacgcaatgttcggcttaactgccaaaacgataacgtcagcagcttgtgccacggccaaattagtgtcacaggcctgtagcccatttttttgcgcataaggttgataactcgcagcatgggcactgtgaatataaatatctgctgggacgaccgcttgttgttttaaccacccatcaataatcgcgcggcccatgttaccggcaccaatgaatccgattttcatccgtaaaacgctcctctgacttataatttatatcattaaccactaaccgattaacggctaggcaggattaaacagacattcccgcttactcttctactataccaatatttatgaaactgtgggtaattaatcacttttttcagctcaactttcactatcaacaaataaatatcacgagccactctattaaggtgattgcttatcaatactgaaaccaattgattaatctattaataatcggccttcaatatgcgcgaagctcgttgacaggtctgcttgaacaagctaatgtaaacagcaatcaaacacagcgttgcttccgaacacggctgtctaaaaacaactaaggagtgtttcactatgaaccagaacaaccatttccgactcaccttatcaaccctgctgcaacaatgccagcaagacatcactagtctgcccacggccatgcgcgccgtcttcagctggcaacggggacttaatgaattaaagacgcttcgccgcaccactaagttgatgatgagcacgatgctaatcgtgaccatcattggttttattctgggccgcgattacagcctacatggctggattggcctattgaccgggattacggtcgtgattaacttaattctggttgatcaagggcgactgacgaactatagttggggcattattgcctgtgcggcttggctgactacggccatcaccaatcggctgattggtgacattgcgtcgcaatcattttaccttatcatgcaatttgtcggcatcaccgtctggcatcgtaaaatggcagcgcaacccgatgccagcgaactgactggtcgtaaattgagcaaattagccggttgttcctggttcgcgttagccatactcgtctacgccattgtcttacactttagtaaacaacttaacggtaaccaaatctacctggacgcgaccctgttaccacttgggattgtcggtagtgtcctcatggtcaacggttatcgttcccaatgggttgcgtggatcacactcgacgtgattaacgttattatctggttcaaccaattaaaaggcttcagtcctgcagccgcctcaatgttagcattgcaactagtgatgctcgctaacgcgttatatggtgcctacttgtggttcttcggtcaaaacactcagcaagataaactagatacacattaagcaagctaactggcaatcaaaaccaagcactaatcgcttcaaagttaaacacataactttgaagcgattttttatttgggttaccgttcgggtggctacatccttatctgaaaaatgtctatcagtttacatttagcgacgagtttgtttaagttagaactaattaactgactattgagggggacgtttaccatggtgacagtcgttcgtcgcacacttcacgataaaatctttattattgcattaatttgtgctggtttaagtttgttcatcgggacaccccaactgacggcaattaattgggctacgattggcaccttatttgcactcatgatcagtgttcaattacttcgcgcgatgcatttgcttgatactttaagggactggctcttagttaaatcacacgatacccgtcaaatgtgtcaattattcatcttactggcctttggtggctcaatgattttaactaacgacgttgcgatcctaacgttaattccaatctttctcacactcgcccggcggcagcacctggccattgcctacccagcgactttaattatcatggcagccaatcttggtagcgcgtttacgcccattggcaatccccaaaatttatttttggtcacgttctatcacgttaatctattcacgttttttaaattatcgaccccgttaatgcttgctagtctagctttattagttgccttaagctggcggttacctcggttgccgctaactgtaacaccaaccaaatctacgcccatttctcgcagtcaaatcgggcttgcgggcggcctgctcagtttcattatgcttggcatttttaatttggtgcccatttcactagttattatcggaacgattgtcgtaggcctcatgattaaccgacgcgtctttcagtacgtcgattacgcactactcttaacctttatctgcttcttcatcttcgttagcgccatcagtcataatcccgcaataacgcattggctcaaccaattgactcagacagcccccagtgtctatattactggactaattactagccaagtcatcagcaatgttccagccgccatcttactagcgaatttcacgccccatttatcagcgctatttttaggcgtcaatatcggcggtctggggtcattggtggcctcactagcaaatctgcttgccttaaaacaattgttgcccttcaatgatgaacaaccactccaccattttttgatcgtgtttacggccctcaatggacttggcctgttcattttaggccttggtggctggttctatttacacctataattcagttacgctgagtaacgattcagtgagaacttgcaaaccaatcaacttgaaatagtgcgaaaaccagtaactagcgtgacatcataaaaggagcagtctcaatatcatgtgagcctgctccttttacgttctatctctgagatgtttagtgatacttagtgcgcctgatccaccaacatggccggagtgacgatttgctgaccatcgtagcggtgacccttgatcacgcgtttcgccctgacaaattcaccatcgaccgtcagcgttaacgcacaaattccaccatcaaacaggcctgaacgactgcctgcatcaattagatatcgtggaacgtcttgcgcatctgcctgcatctttaaataaccagtgtgtgaaccagtcaaggtatgcaccggcgtatgaccagtaatgatgactttattgaataagttccgatgccaacggtgactgccagtcgtgaagtcatcataatagtcatcccgaatccacagtaggtcagtcgttgtttgttgtgttaatgggtattgccagttaacacccgcgtgcatagccagtaaccgaccatgttgccacatcagcggcaaatgtgctaagaaatcagtatccggctttaatagcgcaccatttaatgcccgccgaacatgattgggattggaggagtaaatccctaatttgcgccaggtccgatgaccaccgttcaacactcaagttgcggtggcattgtcatcaccatgagctgtccgtagccaaaattcatcatgattgccaagtaaagccacatcgccgtattcccgtacccgttttctaaccatcgtcagtacttttagcggcgccaacggagctgactcggcggcatgaccaaaatagcgtgccgccgtaccatcaatataatcgcccaagaagatcaagcgcgtcgcggtaacttcaggatcggctaataaaactgccagatcatccgcggcactatgaatatcaccaataaacgtatacagcggcatattactccctccgtctcatcgataaccacgtgcattagtcgggtttaacgaccaccaataacatctgaaatccttgaacggcatataacgcgtgccgggcatccttaggaatcacgatcgattgtcccgcagttaaatgataaatggtgccttcaaccgtaatttccgcttctccacttaaaatattgaccatcgcatcgccctgggcagaatggccgccaatctcttggtcggttgcgactgaaaatagcgtcatacttaaatcatcccgttgaaccagtgtccggctattaacttgatcatcatccagtggaatttgttcagttaaattgaggaccttagcatgatcaattttgttaattaaactcatttgaattcctccgcatctcgctattaaggcctatttcgtttctaattgaataaactggcacggctgctcagcgaccaacgtatggaccgtatgagctggcaccactaacatctcgcccgcatgcacttcttggtcggtctccgtcgccaaacggacggtcaaagtaccatcaacaacctcaaataagcgggtcagcgtggattgttcagcactaatactttcacccgccgccattgcgtacatcgcaaacggcagttcaatccctaattttcgagcaaatgatttactagtaattgcatgctcccggtaagtcatcgtggtttttaaatcaattttagttaccgccatttcaaatcctccttggtcatcatcatggtcgcttacgttattcatgatggtatgattccctaaattaagcttaacgctaacaaactcaattttcgaggttcgattgaataaacatcttataattctgaataactgactactagtcatatacttaataaccacgtcatctctggcaggtaaatgcctttgcatccagatatgggccatgcaaaaagctgtccaagcgtcattgcgacgctgaacagtctgctgttactacatttgataacagttctgtggaaaatttgatttattcagtcaactagttggggctggtagtgggacaactaaggctacgtagcctcttcaaccaaatctcatagatcaagttccaatacgacttattttcgataataagccttggcccagcagttgcgacgctcccgacaccactgttcaaaagtacctacaaacatttggacatcttgcgcaggaattagttcttccgttcgctgcatgtgcacaatatcagatatcaccggatcaaaagtatacgtaacaaccaaatgttgtgggattcttcgaataatcccaccgttacgagtaatctctaatcgcatcgtctccagctcaagttgaacttgcgaataagtctctctggagcaataatcgacaacatcatactgctcataacatcgtttataccaggcatgcgaattagccggcaaaacatcaaattcaccacgattcatacgatttcgaacagcacggttagcgcgcttctttccataacccatatgtgctttaaaaattggtgtgcttttataagaacgactcataataattgtgatggccgtcatgacccgttaactagtacgtatttttaaaattaacaatgccagccattaacctcttccgtgtactgacggaataaataaattcattgaccagacctcctatcccatctggatcgtgccccaaatagaatactaaaacatatcacattattattgatgatggcaaataaacagaccgagacaaaaaaatccacttcgtgaagaatccgttacgcattcttcacgaagtggcactacccgccgatattaagataaatttaagccaataaaaaagtcgttacatcaagatcctaagacctgattaacgacgaaaggcgtaacaattgggctagctgggttcgaaccagcgcatcacgggatcaaaacccgttgccttaccacttggctatagcccaataatgaaatggaggggagtggattcgaaccaccgaacccgaaggagcggatttacagtccgccgcgtttagccagacttcgctacccctccgtaaatcattcaactatattagaatacataattttgaataaaaaatcaagacttttttcaaagttttttcagtttttatttcaaatccagaatttgcgtatcttgataccactccgccataaaattattggcttgccattcattgatacgcttgagtccatagcccactgcttggtcataataggtggtctgaccaaacacccgcggttgcggatggacgtgcaaatgaccaaataaaacgtgcgccacgttaaactgctccaacagttgtcctaaccggggcgttcccattaacgcgttagccatattccaaaaccgattatcatcagaaaaacgcaaataatcgatccggggaacaaagtgcgtcataaaaataacttgcttgtgatccacagcagccaagttaagctgcgcttttacttggttgagcattaaatcagtccgctcctgatcgctcatcggctgtttaatagcccggtcgatccaaaacgcattcttccagtgtaagaagtcggccgcagtcgtatcagggacctgggcagcatactgatagtcataccacccattatgtccaatcacgcgccaatctgtaccagaaatatcgatataccggttatgcaggtagccatcaaaatgccctgtttcaagctcgtcaaacgaaattccatggaccatgtcatgattacccgcaatccagtaaacacgcgtctgtgcgcctaatagggcctgtaaatcgacgacaaactgctgactacgctgaaagtcattaaaaagatcgccagcaatcaaataaatctgaacaccattctgtaaaagataggtcgcctgagatcgcatcatcgcagtcgcatccactcgattaacatcaaaatgattatcactactgaaagcaattcgtacgatggtcaacccctccaaaacaaaaaagatatgctaccactaagataacatatcttcgagtaaatattcaatttagcgaatgccttgcatcgaccgtttaatcattggcaccatcataaagaggataatccctaaaacgacactaacaatcccggtaatcgcaaaatatggcacttcggtttgcgtcgagtagaaacggacaatctgtgcattaagcgcactaccaaccgaatcagttaggaaccacatactcatcatctgagaagcaaaagcctttggtgcaagcttggtggtaactgataaaccaattggtgaaatcaacatttcagcaatttcaacgactgcccaactggcaactaaccaccatggactaaccttccctgcagttccaaagagtgctccaggtacagccatcactaggtaagaagccccagcgaatagcaacccaatcgcaaatttagttggtgaactaggttgttttttaccccacttagtccacaaccacacgaatggtgttgtataaatcatgatgaacaatgggtttagcatttggaaatcagaagcagctagatgggtaaaaccaagatccaaattaacccgattagctgcaaataacgcaagtacggacgaaccctgttcttcaattgcccagaataaagcagcggcaataaacaatgggatataagcccgaacacgtgaacgttctgttgcattagtcttgtcagacgttaacatcaaaataaagtaaacgattggagtcaagataacaagcgtactaattaaactaataacatttgctaacgtaagagcattcattaattgcattaatagtagaatcaacccaatcccaacgattcctaagattgtccaccgcatgatttttttcaaatcaccgggttctaatggatcagttggatagaggctagcagaacttaaattcttcttaccatcaaagtagtattgcaatagaccaaagaacatcccaatcgcagctaaggagaagcctaagtggaagttaacatttaagccgatccgaccaactaaggctggtgcaaccaatgaacctaagttaatcccgaagacgaaaatactaaaaccagcatcccgacgtgtatcttccactgtatacaattgaccaaccatgtcagagacgtttggctttaataacccagtcccaatgacaataagtgcgattgaaacaaatagtgcaccaactccaaatggcgttgataaaacgatgtggcctaacatgatgaagaccccaccaataaagacggtcttacggctaccccagacacggtcacttagaaagccaccgaggacactagaaacgtaaactaatgccgaatagattgacataatggatgctgcggtgacttggtcaaatccaagaccacctttagcgacactgtagtacatgtaatagatcagtagcgcacgcatcccgtagtaactgaatcgttcccacatttcagtgaagaacaacgtccgtaagccacggggttggccaaagaacgaccgatccagcttttgttccttatccaatagagattcctccaaacttcttaaccagtttgtatttcgtttaaaagtaacaagttttgtttcttaattaaacataataactattatactagccttaatcttaatcaacaatagcactaaccgttttctaatctaataaccattaattaaattaatatccaccatacataaatagtcttaaatccttttatagcaccaaaaactagttgatagaacattttataaggcttttagctttctaaaattaacactaaattctaatttaatataaaataattaatagcattcaaatgctgaaaatacgcaattggtattaaaaatctaattaaacaaaaaaacaaaactgaaattatcaacaataaagtaccgctattaaaatggctatgattgttcgcagcatgtaatttacaattattgcgactaattataataaaccgcaagattgatatgctaagcatacctaaaaagcagtggcgacaataggcatcatcctactaagcccttacgatcattttgatacttcggcattcaaatagctaacattcttatatcaaaaaagcagctttgcgtttgcgcaaagctgccaatcattttatgtctatttaaaaataaaaaggcgagaaccacgtcccacctcacaagtgccggctaccagagtcgaactgatgaccctcggtttacgataccgatgctctaccaactgagctaagccggcatgatataaaaatagatgttaacacaattgccaacatctatgtcttgctatctaaaagtgtgtataaacagttgcaagttgactgtgagtggcttacattaaaagtgcagtttatttggagatatggagtaacgggaaatatgaaagcaacgacaaaacaagtattgacaggcgctacctggctagtagttctgctagcaatgatcggtggtaccatgctttggcaacaacaagtccacaagtcaaaaccggtcaccaccataacagtgacttctactgaacgtattccaatggtgctcttactagatgaccacttaactcacaatcagattcagcaattaactgcccatattcaaaacagtagcgccactcagacactggtcaccgccaaaattacagcgacggggaccgtgacatttaaagggcaattgctcaacagtgacaaccgcccctacatacaagtgcaactgcccaagaaccttgattcaaaccgacaaacgcatttattaaagcaactcctaaccgccgcccgccagcagtttaaatttcgccggtttaaccttgtcagttacggtcgtggcggtctcactgccactaactatgtcgaacacacaacaacaagcttatcaccacaacaccttgtactgatggccaccccatttaacggcgccagccgccaaagtaacaatcgtcgccaaacgacgccggttgccgccaagtcgcaaacggccacactagctaaattgattgcacaccgccataccattgattccaagatgcaggtattgattgtcgctggaaaagccatcaaagctgaccaacccctaccactgcaaagtgccctggctggtcaatctatcttcaagccagtggtaaaggtctatcaacaaaaagtgttgcgctcatggcgcacccaatccggcttactcaacaaccatcaaatcggtaatacgattcaaacgtttataaactgatttcacccgtccaatcgacctagccatcatttttgctcagagtgcttatctaaaacatatctaaaagattaatagccacctttcctgacaaccaacttggtctactggaaaagcggctatttttagctttaattgtgcgatctggtcgtagtaagcctttaacgttaaaagcagccagcttaagtccgctgaaaaaagtttaagttagtgccaaccctgcctggttgagcgcgtcctacaacgccttccagtcgggatagcgttcgaatggcggacatgtgcgtattccgtttctgatgaattggccgtggctattttagcgacagcgactttgccatataactgtcagtctgatagtagaattacgactgttccatgatctttatactgaggtattcaaaacagttgatgtcccattaacatttgttcaaagttcttagtagtaaataataatttaacgactaattgcaccagttaggcggtcgttcatctacctttcgagtggcttcccgaaacatgctcaatgccactgaagtctgtgctggctacgccaacgctctgcctaactttgctactgccataacatctgatccggatactccttggtcaaaaactgtttaatggcacgaatcatgatagccgttgaaggagcggtcgcctgggttttgttggcaactaaggcaatctcacgattatagggttcggcaaaggaaaacgtgttaacatctccagttagcttccgtagtgctagctgaggcaaaatgcccatgcctaaaccggattctaccattgaaataatagattgatcatcaatcgagaatcgtaaaaagttattagtaacgtggtagtggtccagtgctagcttggtgtcccggtcataatcgctttgttgtagaataaagttcttatccgcaacgtcatcagtcgtaatgaattcaccattttctgggataaaatcagcgggcgtcacacaatagattggatcattgatcagtgaatgcactaataagttctcattgactggcatcgacgtaaacccaatatcgatagtaccgatcttggcccagttggttatttcattaaagttaccttgcatgactgaaatcttaatatcaggatatttatgattaaattcgcgaataattcggggtaaccagttgatacagacactactgaaaccgccgatccgtaccgatccagagtgcaatccttgaatattatcggcaacttgtcgcaagttactttccgtattcagaatctcttgaacatagggtaaaacctgccgcccatcactagtaagttcaacgcctgaacggttacggatgaatagtggaaaacccagttctttttccaactgattgatcgaatgactgaccgcacttggcgtaacgttaagcgtagcggccgcttgatagaatgtgtgttgggcaacgaccgttgaaaagacttcatatgcgaagtttgccataatgatttacctctcttaggtgaatttatttcacttattattgaaaaagttgagttttactaattacaagctttattttatcatattgataatcaaagaaaacagtttaagtacaaaaaactgagtgggggaaaattattatgaaaaaattatttgcaaatcgcgtgttaaacaatgacacttccgacctagatgaggtcttcaagaatagtgcaaacccggaaaacatttccttcgctggtggttttccagatcagcacttattccctgacaacgacttaaagcaagcctatcgtgatgctattgaacacgatggtcaaggcatcttccaatactcatcaactcaagggctgccggcattacgccaaaaaattgcagatcgaatggcgactcatgctgacgttcaagttagtgccgacaatgtcatgatgactcaaggtggtcagcaagccatcgacctcgtggcgaagctcatgttgaaccatggagatgccatggtcgtcgaaggcccgacttacatgggggctttagccgccttcgacacttacgaaccgacttactacgaaattccagttgatgataatgggatgaatattcgtcaacttcgtaaaaccttgaaagctcatcctgagatcaaattgatttacacgattcctgacttccacaatccaacgggtacgacgatgagtgccaaacgtcgtcaagcactcgttgcccttgccaatcagtacgacgtcattattttggaagacagcccgtaccgggacctccgttatagtggtcaaaatattccggctatcaaacactacgatactgaaggccgcgtcatctttatctcaagtttctcaaagattctctccccggccttgcgaacaggctggattgttgctgacgacgcaatcatgcacgaattggtcggactgaaatccgcaatcgatgttcaatcgccaaatgtaacactggctgctatcaacagctacctagatcaacacgacatcgacgatcacgttgcaactattagtacttcataccggattaaacgtgacgcgatgttagccgcactcgataaatacttcccgcaaaatgtccactacacccgtcctaatgggggcttcttcatctgggtaaccttgccagaaggaattgatgctaaaaccttgctcaatgacgttgttttaccgcaagcacacgttgcctatgtgccatccgcttgccaattcgcaagtcgcaaggttaaaaacgggttccggttgaatttcaccagtctcgacgtcgaaacgattacgctgggaattaaacgccttggccacatcttacaaccggcaccagtaactgttccagcagcatcgttcgcaccccaattctagcttgacccactcatcatgcgactaaccgtaataattgcgattagtcgcattttttgattacatctgtcagctgtaatgagtggtcgtgatcctgaatattagcactttttatatcaggatccacatcaaataagccgtacgctttacgaccatttatactgtatcagtttgagcacccgcgcttgcgtcgcttttactgataaaaaagggtttgacagtccttctctgattcgctacactaacgctatactagccgattatgaaataagcattggtccgtttgcgacactcaatgcttattttttgttaacagcttcattttcggataaactaggagtgttgtgaaaaatttctaggagtgtgaatcatgaagtcatgggttaaaaaattaggcgttgcagtgcttgggttaggtttagcagttacattgaccgcctgtggtagtaacactagcagcagttcaaagtctaacgacctcggattgcaaaaatcggggacgttgacgattggcttagaaggcacttttcaaccatatagctaccgtaaagacggtaaattaactggtttcgaagttgacctcgggaaagccgttgccaagaagatgggactaaaagctaaatttgtaccaacgaagttcgattcgttagtagctggtttagacacaaacaaattcgacgttgtcatgaataacatgtccgaaacggcggcccgaaagaagaagtatctcttctcgaccccttacatttattctaaatcacaattagccgtcaagaagaactcatcgattagtaagattaccgatattaagggtaagaaagttgccgaaacaacgactagcaataacgcaacggatgctaaacgtttaggtgcaaccatcaccccaaccgatagtttccaacagtcgatcgacctcgtctcacaaggccgcgtcgctgggactattaattctcgtgaatccttctatgcttacttcaagcagaatccgaaggctaacattaagctgattgattccggcgatcacattgcctcacagaaaatcggggccatcgtcactaagcaacaccctaagatgcaaaaacaaatctcgaaagcaatccaagaattacgcaaggacggcacgttaaagaaattgtccaataagtattttggtggtaacgttactgataagtaacgtaccattgcccgctattatggcgggatacatagcaccaaattctaatttgttacaggaggctccctatggattcaatctggcacatcattgtcacatcaacgccgcaaattgctgcagcgggtttaaaatataccattccgattgccattatttcgtttattctcggtttgatacttgcgattttcacggccctcgtcaagatttcgactcgtcgtggttggtttttaattctaaaagccatcgctaacttctacgtctggctctttcggagtaccccactgctagtacaactctttatcgtctatttcgggcttccctaccttaaaatcaaagggctctttccaaatggggtccagctcgacccctggactgctgggattgccactttttcactgaacaccggggcttactgtgcggaaacgattcgagcagcaattctctccattcctcaaggtcagtgggaagcggcctactcgattggcatgaccaagtcacaagtactcaaacgaattattttgccgcaagctgcgcgagtctcactaccgccactatccaatagttttattagcttagtcaaggacacctccttggccgcttcaatcacgattattgaaatgttcgaagtcagccaacaaattgccgctcaaaattatcaaccacttgtgatgtactccctggttgctgccctatacgcaattctatgtacgattctcagctggctacaaagctacttggaaaagcggacgtcacgttacttacggccacttaattaggaggttgtcgaatgatcaaattagaacacttaaataagacgtttggcaatcaccaggcgttaaccgatatcaatactgaatttaaagaacaccagacgaccgtcatcgttggcccctcgggttctggtaaatcaaccttactgcggtcactaaatttgcttgaacggcccgaacaaggtttataccacttcaatgacgaaactatcgactttactaagccgttgactaataaaacaattctcaatattcgacgcaaaactgggatggtctttcaaggttataatctgtttccccatctcagcgttgttaaaaatgtcatggaaggccccgtgcaagtcttaaaaaaggattccgcgacggctaaaaagtccgcgctagaattgttggcccgggtcggcttgcaagataaggccgacgcctaccccgaacaattatccggtgggcaacaacaacgggtcgcgattgcgcgctcgttagcgatggatcccgaattcatcttgttagatgagccaactagtgcgctagaccccgaactcgaagctggtgtgctccgcgttctactagccctcgctcaggaagaagactccatgattatcgtcactcacaacatggaatttgcccgcgcagttgcggataagatcctatttgttgaagatggcaaaattctgttcgacgggacacccgctgaattctttaagcagccaacgcaacgaattgccgacttcttagccgcgatgacgttcaccacgatttcagacaaagcaaaccaatagcgttcatttgagttaacgtgcatctaactggaaaatcccagtcagatgcacgttttttagcaccccctagcgtctcacatcaaccatcgatctggcgcattcacaacaaatggcatttagattaatataaaatgtgattttgatttgacaattgttatttaatcttgtagactagcctcaatatctaaacattgtgatgagatgagtagtgtgattgccacgcaaagcgagccgttggttggtgtaaaacggtcggacagtgatacgaagatggtctctaaatggtattggtgagcattagcaagccagtaacgcgtcgtacccgttagcgtactgagtgaattagctcattgagccaagcgttgtgcacgcgcttggaaactaaggtggtaccacgatcagcagtcgtcctttttcgataaaggacgactttttttgtcaaaaaatatagctctacgggggtaatcgatatgaaaaaatggctcaaagcagtaagtttaacaattttaggactcgcactaacagtcaccttgacggcatgcggtaattctagctcatctaaaagcagcacttctagcacaagtagtcagctcaaattgcaaaagagcggcacgttgacgatcgggctagaaggcaccttccagccttatagctatcgcaaagacggtaagttgactggttttgaagtcgaccttggtaaagccgtcgctaaaaagctcggtctcaaggcaaagttcgtcccaacgaaattcgactccttgattgctggcctggatgtcgataaatacgacgtggtcatcaacgatatcgctgaaactgcgcaacgtaaacaaaaatacctcttctctacgccttatatctactctaaatccgaattagcggtcaagaaggggtcctcaattaacaagatcacggatatcaaaggcaagaaagttgcccaaacaacgactagtaataacgcgaccgatgctaaacgtttaggtgcgaccgtcacaccgaccgatggctttcaacaatcgatcgacctcgtaaaccaaggtcgcgtcgccggaacaatcaactcacgggaagcattctatgcttacctcaagcagaatccaaaggccagcttgaaattcattagtggtggttcagaaatcaaaacacaaaagattggcgcaattgtcactaaaaagcacgcctcactccaaaaacaactgtctaaagcgattcaagaactccgtcaagatggcaccttaaagaaactgtctaataaatactttggtggtaacgtcacaaaccaatagccatcgcaatctatttgataacgtccagttgatagtcacaaaaagcccggaaaaccgggctttttgtgtgtgtcggcgtctttcagcgaccatcttttatcactcattgtgtttctaaaaaccatccgggaccatttacaccattgcttatgtcgtgaacccggtcagctaattcaactgatttgcaatattgaatttcatcttgccatgattgacttccaaccacatatatttggtgttcttaggcgacaaaacctcaatatgtgaatatttttgattgtgattcttcgcgattttttcagagcggctttgcagtgtcttggctagtgactgccacgaagcggtcttgccttgatcgacactttcaataactggcgcttgctttgatattcgcacacgcatggcaccaccattccaactcactttaaccttgccatattcagctttattcgttctgatttctgattgaatattggctgcaagcgtattagcttcccgagcctgatacaaattaaatccaatctcaaagacaatgactagcgcacagataactggtggcaaccaaaaccaccacgtccgtaagctctttttttgatgatgcggctgctttaaagtcgtcgtttccgcgtctttacgcttatcctcagcaactgtcggttgtccactgccacattttccacaatactgggcactttggggaattcgttcaccacaaaccacacaattcttcatgtccgtttccataattgccctccgtcataatattatcgataataattaactcagccatgacaattaactgtattaatatttcaatataatgattatatatcgaaatcagtcatttttctaggccttatcagatcagtatagtatcactcttgcgtaccggacagctggtattcgctgagcatcatgattttaagctttagtacgggcctatttcagtcaccgttagcaagcacgttttgcgtttactagtggctaaaagtagtttgccttttatcattattttaatatttaagtttgacagttagtttcacttcactgtatactactcattgagcaatactatacgacgtataatatagcaggagggatagcaatggccattcaaattagttccgagttattggacgggtgcgttttagcctgccttaaaggccaagattactatggttacgcgctaacgcagcgcttgcaagccgccatctcggtgtccgaatcgacgctctacccagtgcttcgacgactcaagaaaaatgactgggtcacgacttacgatcaggcctatcaaggccgcaaccgacgctattatcagattacgagcgccggcctgacacaattgagtgcgattcaacaagagtggcaaacctattatttggccattaaccacttacttcagggggaggatgaatcatgaacgactacttatctaaatttaacgcgttactcgttcaacttaccgatgatgaacgcgacgaggtcgttgaattttatcgcgaatacttgctagacgcggcaatcgccaattatgatgattgcgttgcagaactgggaacgcctaaacaattggctcggaaagtgttagccgattattcgattcgttttaacgaaaatctcaacgccaatacttctaaacggcaaaaatctcaagcaaccgtacgcacgatttggctaattgtgcttgctttattatcaacaccgatcacaattcccgcattaatagttattttagcggtcttctttgccttggccgttaccgtctttgcattcgtgattgcagcgggtgccatcttaattggcgtgaccatcctcgcatttgccatgctaacagccggcatcggtatcttcggccagtcgctatgggtcgcactattctacctaggtagcggtcttgctattattggtgccgagctattagttttaccactatttatctggcttattagcgttattctgcaaggaattgccaaaatcgtacaaaacctataccaccgatttgttaagaaaaatcgggcggaacgaggaggtcaccaccatgcgaaagacaattagagttggcattattttattagttgttggactgcttctaatcatgtttggaattgccaataacggtattcaaagcgtctattgggaccagggttttcacattgttcgccataagactcggcgctaccacgtcagtcagctaaaagatatcacgattgcaacggccaacaatattactattaagcaaggcacagctgctaatatcacggttaccgccacgcgcgccttaccaactgttacgatcaacaatggtcacgtcactgttacttcaacgacacacaacgccaaaaccgtgggcttcatgttcgataacgtcggacaatttgctgacacgacaataattacggtgcctaaaggaactactattcatcaaataaccgccaaagctagtcaaagtggtaacgtttcgttgcaaaacgtcaccgtcgaccaattgaaaagtcttagtacggatagcgatattaatttaacggatgtcaaagtcaatcagtcgctgacgttgaccggcgataatttacggttaactcgtgtctcggcgcctagtctacaaatcaatagcgatccagatatcagcatcaccgacagtcattttaccaagactgcttcaaaaattataaccgctgatagcgacatccatctaaccaataatcagttcaaagcccttaagctaacaagtagcgaaggtgatattatgctcaataataatcgcatcactgaaagtttatccgctacagccagtgacggtgatattcgaataaccgcgccacggacagccggtgttaaagctagcactagcgatggggacttgcatattttcaatcatctccagtccgatggcggtgattaccaggtcaaccaatcggcagccgtacaataccgactgacgaccagcaatggtgatattacggttagtgctagctagtccatgctagtactgcacttactcaaattttcaaaataaaaccgcggcttgctcatggcaaatcgcggttttatcgtacttacgtttaggatgctgttgcagtcgtcatttccggacgcccttgaatcgccagcagtgctgctcccgactgaatagactgattaggttctgattctatccgttgataatttttactatttgtcacaatcaccatgactgtgtcatctaagttagcagcttttaacaccgttgagtcaaactcacctaagagatcacccttttgaacagtttgccccggtttaacgacaactctaaagccttgcccttttaatgacaccgtatcaataccgatgtgaatcaacaactcaactccattattggttgttagaccataggcatgtcctgtatcggctacaacactcatctgaccactttgtggcgcatagacttttaccggcccctgttcctgtggcttaattgcaatgccgtcccccatcatcttagatgcaaagaccggatcgttaaccgtactcaaggcaatacttttaccagaaactggtgaaaatatcgtatcatccacaatctttggttgtacttgatcagattttaatatgtccttaggaatcgcaaacatattagtggcaataaaagccactgctaccgtcaataacgagacgaccgtataaatcagcaaatcacgagcattgtaaatatacatcagataagagggaacaacggctagaccatatgaatttgctgccacactcataacactcagtacgccagcacctatcccactggttaaaacggttacaaccaacggcttgaaattatagcgaatcaagaccccgaacaaggttggttctgaaacaccaaatagttgcgaggaaaatgcgccaataaaattagccttagccttttgtgactttgctcgtaaaatcatcgccaaagctacccccagattagcaaagccatacatggcttctaaagtaattaacggattgagcttggtggctgctaatagtgacgtttcgatggcaatcatcatctgatgaataccaactagcaccattaacggataagcggctccaatcaaaaaaccaccaattccaaatggtaagttaatcaacccttcaacaccactaatcatcacattttcaatccagtgtacaaccgggccaacccctaaaatcataataccaaaagtaactaacatcgttaaaaagggcgttaaaatttggtcgagaacgttagggacgtgtttatgaaagtaatgctccagtttacttccaagaaaaccagcaactaacgctgttaatacggatccttgactaccgataactggaatcctgtcaaaaagcataatcgctttcgctgtaccacccgcaactgaatacgcgttaggcagtgaaggggaaacgagcattagtccaatcacaataccgacaattggtgtacctttaaaatagcgaaatgtggaccaaacaattaaagctggcagaaatgaaaaaacagtccccgttaaaactgaaattactgtattaagacttgccggaatcgcggcagatgaagttccaaacaactgtaaaacctgattgttagtcaaagcactttgtaatcccaagaaaagtccagtagctgcaatcaccggaataattggaataaagattcccgaaagcattgccatgaatcgttgcaatggtgacttctgattatcaggagtcggcgtagtcgtcgtttcctgactataaattgcattaactaaatgtaacttttcaattgcgtcatacacatcgttaacaacaccagtgccaataatgacctgatactgtcctgaaccgaaaaagactcccttaacctcatctaagtcttcaagtgctgctttatcaatctgcttaggatctttaacaacaaaccgcaaccgtgtctgacaatgagtaaccgattcaacattgtcaacaccaacaatatcaataatttttttcgcaagtacctgatagtttttactcatttgaattcacctcaaaaagaatggcttgatatggttccaacgtattgagtcgataatgtgcgtaattatttaatcgaggtcggccattaggtaacgttaggaataaccgttttgcgcttaagttaacatacacctgtacccttcgaccacgttgataagcaatcacttggtcacaatcacaagtaattggcctaaaatcaccgactattaaatcctgacttaaatttgatatttgccgtaacttaatcaatgactgataaaaatgccaaactgaatttgaatctaattgttcgctttgccagtttaccctatcatgtgactgttttggtgtaatccatggcttggcaccctgattaaagccttgattgacggaatcatcccatggatatggtaatcgcgcattatcccgggaacgagcatttacaaaggcaagtgcctcgcttgctgaatatccctcttcaatagcacgatcataattatcgtgactgctcaagtcgttaaacatggtaattgagtcacgccgtgcattggtcacccccagctcttgtccttgataaataaatggacaaccgcgcaagttaaaataaagtaaggctagtgctttggcaccaatttcattccgataagctggtgtctgaatatatttatcaatactccgcggctgatcgtgattttcaaaaaagttagctccccagccgacattttgaatcgccagttggcttttaaaaattgcgcgccgtaagtccgtcggtgtccacttaactcgtcgataccactctgatccggatgcaatatcaatatctgcgtaatgaaagtcaaaaatcatcgagaagtaaccttttttaccaataaattgtccaagttggtcataactaacccccgaagcctctccaaccgtcaccgcgttagctggtttaaaagtagccgtgttcaattcagctaagaacttttcaataccaggtcgattttcagctttacgtttgactttacctaacccatcaacaccatcaggactaatgctggcaaaatcttgatctttttttatgaatgttattgcatcgatccgaaaacccgcaaccccttttgccaaccaccaattaatcatttgatagattcgtttccttagagccggattttcccaatttaggtccggttgttgtttagaaaagacatggtgataatactcatcctgacttcctggcaataacgtccatgacgagcctttaccaaagtttgatcgccaattattaggcggattgccgtgtgccccacgccgaataatataaaaatcacgatacggactcgtcggcgatttaattgcagattggaaccacacgtgctgatcagaggtatgattgataaccaaatctaaaatgacttttaatcctaatcgtttagttacttccatcaactcatcaaaatcagccatcgttccaaaccgagaatcaatagcttggtagtcagaaatatcgtaaccgttatcaaccatgggtgattgatatattggagataaccagatagtcgtaattcccagctgtttcaaccggggtaacatttggatgattccacgcaaatccccaatgccatcgttattagcatctttaaatgatgccggataaatttgataaaaaacttctttttgccaccaatttttttgcataattactactcctatatttggaatcgattccactttaatcaaaagaaaaaggcttaagcactttttcttttgattaagtctaagcttagatcaatcgttaactcaggtcgttgtaaccggcccaagtgatgtaatagctgatcgaccgccaattgagccattgccgcgaccggttgtcgaaccgttgttaatggaacttgggccaccgccgcaaatggttgatcgtcatatcccatcacggccatatcatctggtacgcgaaaatgttgttgctgtaactcatcaattaccccaacggccacctcatcagaattggtaaacaccgctgtcgggcgatcactagggtttaaggacgctaattgcttccccaacgcttgtccatccgcaatcgtatgttgttgtgtgaaaacccagttattgtttacaactaactgctgctcttcacaaaaatctaaataggcttgcgtccgcgaacgtccatgatgcgtactgggaaaatcaccacccgtggcataggcaattcgccgatgaccttgatgatataagtatgccaaagcatctttagttgcctgataatgatttaaactgatcattggaataccaatatcagtagcttcttcattcaacagcaccatctgattagcatacgtcgccgacaattgtgccactagttgttgattttcaatggatgccagaatgacgccatccacttgttgctgcttgagtttatccagaaagtgttgttctgccaacgcatcatcatgagtctgcattaccatcacttgaaacccgtatccgtttaactcccgttccaatgcatcaaataactgtgcaaagaaggggttagagattcttgataccagtacaccaatcgtattagtgctctgcgcgcgtagctgactcgcaatggcattcggggtgtaatccagtttttcaatcgctgcctgaatctgtttcttcttagcaactgaaacactaggccgatggtttaaataccgcgaaacagtcccaacacctacaccagcctcagctgctatttcactaatcgttgtcatttaggctcaccccccctatttggaatcgtttccataattaatataacgacctttcaagtaattgtcaagacaaattggtttttcaaaatgaattcactaaaaacgtttgcccttaaaacatttagtccaccattaaaaaaatggcagtatactgccatttttctgtttttcggtttgaaatggaagtatactgccatttcgataacttcatttttaacattccagccaaaaaaatattccaagccagcgtacacctgacttggaatattttaattactgattcagccttagtaatcgctataacgatgcttgatagacatcaaaccacgtcaataatagcgacacaatcaagataccaagcatcgccaccgcgtgccaccatttatttcggacaaatatcgcaatatactcacgaatgatcgcatccggtaagaagaatcgcgccgtccgcgcaccaataccatccgcttttagacctgcttgcttggcaaacatcccggctctaaaggtatggtaattatttgtaacaaaaatcgtgcgtggatttttaacagggccctgtgcaatcaattgcttactaaactgcatattttgcaaggtcgtcttcgattgcgtctccgcccagccatccgttgcaggaaggccatgcgcaatggcgtattccagcatggcttggccttccggaaccgtttcatcaccaccctgaccacctgagaaaatcatcacggcccgatgatgcgtcttgcgttgttgcttctgataaaagcgcagtccacgcatgattcgttgccctagcaatggcgagacacggtctccatctaacaagccagccccaagcacaataatataatcttgtcgcagacggggccaattgaattgataaatcgtcagcatcgtcagatagttataaaaccaaaaaccaaggtaaaaaatgaccagattcggaaataccgtcaaaaaataactcacgggctgcggcacatgactactcaacagattgcctaaaaatggcaaaatcagaatggccagtcccaagtacaaggtcagcatattcgccaacgtatgactctcatgacgccacatgatccacgcattccataagagcaagaaggcttgtaaggtaaaaatcagcccaatcaacaggatcagcaacacaaacaacgtcccactgataatgatcaaccagtggatattgctacctaaaattgtaatcgccagcatggttaaaaacgaatagaaaaatagcgaaaaccaaataccgttacctaggcgaaccttatcgcgatgataacgccaaccaaaaatggttccaaatatgagtggtactaaccagccccagtaaaacattgctggaactggaacccaaaccgctgcgtcattcacatcaatacccccgcattaagttttatttcagcttccatcataaaggactccccgcgggactgcaatcaggagtcattacttcaactgtttttgttcattatagaaattacggtaagctaaatagcacgcaatgattgaccccaaactagtcgctgataagagcatgaacgtgaccataatttgatacttaatggcccgtactggatcgacccctgcaaagatcaaaccggacatcatccctggcagactgactagacccacagtctttgccgaatcaatggttggtgacatccccgtacgaatcgcctcacgcacgatggcaatcgaagcgtcgagtagaccagcccctaacgccaaccgttcaagcacaccttgccgctggtcatgaaactgactattgaggctgcgataagccagcccaattgcgaccattgaattcgacgcaatcataccagaaatgggaatcatttgcgatggcacaaacttaatcgcaccagatagcacgaggacgccgagtgttacccccgtactaacaaaaatggctaataacgaaatggctaatgcatggtcaatccccggcccccgttttttcgcattccaagccgcattgaagataatgaagcccatcatcgccaacgttagccacaaattgttgactcggaaaatatactttagcaagtaacccacgataaatagttgtacaacagcccgcacgacaccaatgacgatgtccttatccaagccaagtttctgccacaaactaattcctaacgcgacgagcactaacattgccgccaaaaatagcgacgtattattaactgctaaattcatgcatgtacctccaatctgccagcaaccactttcgctaattgatctgccgcagcaatctctgtcgcgtcatgagtaatcatgattgttgtcacgtgatcctgctcatttaactgtcgtaaccaggcgtgcacgatttgcttattattttcatccaaaccagctgtcacctcatctaataacaacacttttggtaagaataagatgttgcgaatcagcgcgacccgctgccgttcaccaccggaaagctcggtaatcggctgatgcagggttcgttcggacagcccaacattatttaacgccgttaccactcgttgcgtatccatgacttgcttacgaatttggtacgggaaagctaagttatctgccaccgtctcaccaaatagcgtcggctgttggaaacaatatgagacttgccgccgatacatgattgggtcatagctttcaatcggctgcccatcaaaaatcaaggtcccacttgttttagaaatcatggccgcaatgatccgtaataacgtacttttcccaccaccggatggtcccgtcaatgtaatatgagccccagctgaaatctgccaatcaacatcatgtaaaatatgttgatcagcgatttgataattaactttttctaaactaatcaatgaattcatatgcccacccccgattactaatttagaatcattataacctgactgttaggcgactttcaaacaatcctcctcagttatcctgtgtctttccacatgctataatggaggttaacacagttcacagaaaaacgaggtcaaaatcaaacttatgccacaatctaatcattattcgcaccaatcccgatcgcacaatgatcggcgccgacaacagccggatgaaaaagtgcaagcgaccgttaacatcggccagcgttttccactgaccattcggcgtttaggcattaacggtgaaggtattggctattacaaacacgtcatcaccttcgtcaagggcgcccttcctgaagaagtcgttgttgctgaagtaaccgccgtgcacccacgttacctagaagctaagattcgtagtattcgcaagcctagtcctgaccgggtcgatccccgcgatgcctatgcgggcgaagtcggtggttttgaattagaacacctcgactacccggcccaattagcctttaagcaagatttaattcgtcaagcactcgaaaaataccgcccagctggttatcgacactatgatgttcggcccaccattgggatgactaatccttatgaataccgcaacaaagcccaatttcaagttcgtttaattgatgggcacgtcgctgctggcttatataaagaaaatagtcatgacctagtcgacttaccgacctgttcggtgcaaatgccggcgacaatgacagtcatgcgtcaagtcgtggcttggctggaggaactccaagtaccgatttacgatgaagaacataattctggcatcgtcaagacaatcgttgtgcgtgaagcggccgccactggtgaaattcagctggtcttcatcacaaatacacccaagttaccgaaaaagcatcaattattgatgaaaatcgctgaaaaactgccaatggtcgtgtcggtcatgcaaaatatcaatgctggtaaaacttcattgatctggggtgaccaaacaacattactggccggcaaaccaactattacggaggaactagacggcctagtcttcgatttatctgctcgggccttcttccaattgaacccgcagcaaaccaagaaactctatcgcttagcacacgaagctttgaacttagcgcctaatgagacgctggtcgacgcttattcgggcgtcggaacgattggtttatcactagccgacgtggctaaggaagttcggggaatggataccattccggcagccgttgcagatgccaatgccaacgcccaacgcaatcaaatcactaatgctcattacgaagttggtgaggcggaagtcttgttaccgcaatggttagcgagcggttttgcgcctgatgcaatggtcgttgatccaccccgtactggtttagataacgtcttaattgatgccatcttacaaagcgcaccggaaaaactcgtctacatttcatgtaacccatcgacgcttgctcaggatttacaagcacttacccgcggatatcaagtcgactatattcaatcgatcgacatgttcccacaaacagctcgttgcgaagccgtcgtccgcttcacgaagcgtcattaatttgccactcactgccaatcatatgagggggaatcatcatggcagctactgatagtcaaattgcattaacgatgacctttacgttacggccaccattcaagactcatttcttactattaaaagattacgtggcggatgttcgtataccggctcgtgatgggatgctaacgacgattattgccaaaaacattccgctatcaccggccctagagcaactaaaaacgatttttgatgatgtccaaaacccagtttactggcgcttacacgaccaagccgttcaggaattcttcagtgcgcatcctgaacagcgaccggtcctgccaatcgacttgctgcaagtcatgctcaatacattatctgcccaaggtttgtccgatcaacaattaatgcacattatgaaggacgtttttgaacggttacaaaccaatgacttcaacggacaggcatcacagcgaattttgacgtcgttgaataataagtagtccgttatatgctcaacatgagccaactgattttcagttattttccgaattactttcactttggttttaatacctttaaaccaaattacaaaataaccacttcgagaatttacaattaattcttgaagtggttattttttgcaatcataccagtatctatttgtcttttttaacaattacccaagatctcacataaccaatgtttccaaaaatttacacctttcaagtaaaaaatgactattggaattaactactttttacttgtgagctcatgctaatgattgatgactatgtgaaatttggtaaactctcttggcattatcactcaaaacattctcaataacattagtgtcaacatctaactttctaaccatggctggcccagctgtcatccatgctgtcttcactggataggatgaaccatatatcacattgttagcacctaaaaccttaattgccatttcaatattatccgctccccacggctgagcatgtgaaacttcataaaatatattgtgctctaaccggtgttttacgctagtactatttgttgtatcaaagcggccattaccagaatcatgtggtaataacattgtcttgtaagtaaagaagccaccaccaagcatcgaatgaattaattgtaaatctggtaattcaacaaataggtcactaaagacttcacgaccaatcgcagttatctgatcctcacatcgtccataggaccgccgtaaattttcataatccttgattgcaccatactccattggtactggcgaatggtgtacataaaccggaatattcttagccgcaacatgacggaagaaatccctatacaccggactatctaagtaaccatccgcataatgggtcgataattgaagaccgcatagtccaagttcatcaatacagtaatcaagttcggcaaggttttcttcatccgcataaggaggaaccgtagccaatgcaaccatccgaccgtgacttttttgcacgtgctttgcaaccgcacgattgaacactctgcacaaatcaagattaagccattcttcgcaaccgggtaattttaaaaccgccatgtcgacttgccccgcatccatatcccgtagttgatgatcgagttggtagtcattttgaaaataatctaaactactttgaccgattggctcttcaatcacgatcttttttgatccatcagcattagtactgaccgtcgctctggaatcttgaccattgtcaaccgcctgaataaacttagcttgtaacgctggatcagtaaataactcatctggtagccagtagacattcgcatcaataatcattaaaaatcgctccttacactatcaatcattagtcgcaaccgctgtaactgattcaactgaatttgattgtaattcaacatctagtaccttagtatccttggtaaccggtccaaattgggttggcataacactctttaaacgttccgatttggtcaccaccatcataaccgtcgtatcataacctgctgcactgatagcggcttcgtcaaaatcaaccaacaaatcaccctttttaactcgcatgccttgagcaacatgcatcttgaaatgcttgccttcaagattaaccgtatcaataccaatatgaattaaaacttcctcgccatcatcactagccaagccaaccgcatggccggttggataagccactcgaacgataccagtaactggtgcgtacaccttaccatcactaggctttactgcaattccatcacctaaaactaactttgagaaaacatcatcatgaactgtcgtcaagtcaaaactttcgcccgcaaccggtgcgtatacatcactatgttctgcaagatgacgttcagctggcttcgacttagcgtcctttttagctccagcaatcaatgccgcaattaaggcaaagacaaaagcaacaatcccactaatacatagtccgataaaaccggcatcaatccccttcggattaatgaaacatggcaaacctaagataccgctagcaccgaatgagtaaagttttgatcccgagaagccggcaattgcgccaccaattccggcagcaaggaatgaagtcaataacactttcttacgtggaattaacacaccatagagggcaggctcattaattccaaagaaagcagaaattgcagcagcaactgacatactttttactcgttcatcacgtgctcgaattgcaacaccaatcgcagagcctagaacagctaagccaccggcaaaaatcaatggattaataacatcatatccgtaatgggcaacatcaattgcaaagaacgggataacagcccagtgcaaaccaaacattactagaatgctccagaaaaatccaagtaagaaaccagcaattcctttgttgagaccaactaaccacagtaccgtgtcactcagaatattctgtaaaatcatcgcgattggtccgatgacaatcaaactaacaacgccggcaattaggagtgtgaaaaatggtacaaaaaccatttttaaaacatccggaataactttgtcgcaatatttgtatacataactggcaaaccagacgatgataatgatcgggataactgtactcgagtaagattgcaaagcaactggaatacccaaaaatgtcattttatatttcagcgcaaaaatagttcccttaaaaattgtcgtcactgccgtactactagcagctgtagccagcgttggataaaccaaaaatgctcctaatgtaacgccataaatttctttcaaaccaaacttccgtgcggcactccagccaacaacgattgggaaaaaataaaagagcgtatcacctaatgcacttaaaataatatatgtgccacttttagcagttaataaacctatcaccatacatagcgacaagatagccttaatcatcccagccccagacagcaagccaagtactggaataaaaatcgaactgataaggcccaacgctttatttaagaatcctttttcctcggtttcatcacttgttggtgcagcaatctcactgctattgatgacattatctgaaaaattagcaacatctataatggcgtcatacacactacccacactcggaccaatcacgacctgatactgccccccttgcttaacaacatcaaggacgccatcaaggtctctgataacttcatcattagcttgtgattcatcatttaaaacgaaccgtacccgcgtaacacaatgtgtgatacttctaacattacttttcgtcccaatattttttaaaatttctttagcaagcggtttataatccatgtttgacaaccccttcaatcattttttatcggttaatattgacgtaatcgacttattctcagggagtcccgattatgactcgttgttaatcaatgatttacttcataaacgtctaagatttggctaccagtcacaaatttagcaataatttcttcaaacgtaccggccggcaccggattaccaatcgtttcaaaagacaacccatagtcttgcgcctgtaagaaataatagtgaaagccgttacaatatccggctacaaggactgttttatctgtcgaagctcgtaagcttttggcccctgctgaagctaattcacccggaaaaacaaagagacgtaattccccgatatccagcaattgtaggctcaataaatcatgaaactggggcttattaagttgatcttcgcatttctcaacgattgcttcgactgattgtgagccaattgctttaataacaccacttcgtaaatcgttgatcattgtacgcaattttcgatcatatatcggcttatcatttacgacttcatgactcaacgttaatgtttgaatcttgccaagacatagccgcttaggcgtctgaatcttagaaatggcgacggccaggcctgaactcgcacgttctaattcggcaaaatcacgcccttgccgctcataacgattactcgaatctgccgcacaaccaatcaacattagcgggaagaatccccactccttagctagcttagtacaagtattcccagcaagatcagccgttaagtattgattatcaggtcctaaaactgttgaatgaactgccatatttacaattcctgcaactgcatggccatccgcaataaacttaatgacactaaccgcattatcagatggcttattagcatgattacgattactataaaacccaaaaatttcttgctgaccatactgtacagtcacatccgttagcgtttctcgacaatcttcaaaagcctgcacaaaactatccacaaaaaaatcatagtaagtctgactaaatttgccgaattcccaagtacgatgataatcacgtactgagtgatgatcatgggtcacgccaatgatgacatggtccatagcaatgccatatttacgactaattttttgtcgaatatcagctgccacaatatcttctaactccaatagatccccagtcgctaaaaaacattcattccccttatcatcgtaaaaaaggagtgcattgatatatatatgatcatgaatccccttagctggctgatttctgagttctgttttgtaccctagcaaataaaacggttctgtcggggtaatatctttcctagcatgtcctactaacatttaatattcctcctcacttatcttttgtcttaactgcacacaagcctcgagcatacactgatcagcagttaaacccaattgtgtattcattgattggtatgtgattctttcaaaatcgatttgctccggcaagtacttagcagcgccattaactaatgtcgcaatcatagtattggtattaccggctagtgcctgtcgacaactatctccaaatgaactattcagttctggttcagtgcctacaatttcatattgatttaatcgtagcgcccacaaatggagtgtcgtcgtctgtttagttgattggaaatcataagtttttgttggcttaatttcaaatgtactacgctgctgaacttgagtcggaacaatcactggtaattggctactgcggagttgccgcaatgattgccaatcatgaacattctgaaccgcccattccagtttctcagtaacaatggtcgcttgattggctagtaacgccttattgactgcaaatggctgatttgctttcccggtaaagagtggtcgttgatcacccgcgcatcctggaataaaaattgctactcggtcgtttccctcatatgctttaataccatttcccatcagatcactggaaatcatttgctccccgtgatcgtccgtaacatgatccaaaacactctgttgaatatcgtaattcaccaataaattagtcgtcttatctgccttccgaaacgccagaactcgcaattgatgattgctatagccttcgaggttacgtcctagccaccagccttgcttagtcaaaacattacgattgacattgagtggacaattgatattcacttgaccaacctgaacagcttgtaaatcttcatgggcctgtcgacatgcaagcatcaaactttcttttaacttctcatcaattaatcgataagctgactttctagccattgagtcagtcgtacttggtagatgtggtgcagcaaatgtatgtgttacagtcacccatatttggtttgaatcaatcgctaacaacctagcagccaattcttgatatcgtttaatagcagctgcccgcaatgacgttaaatcaaacgaaatgagcgcccaactatttttcccactgattaacatgacgcgacaatataagtcgtccagttttgacttgaattcacgaatcggtagttcgctcgcgctgaattgaatcattgctttaccacaacccaccttaaagttcgccataaatatttcctcctttctcagacgaagaaaccgttttctatattcttattatggtcagtttccatttgacacgcaattctaagtctgactatacttattccagcaaagaataaagcgatttcaatttgttacaaatttatacgaggtggccttgcaatggatttacaatacttagataactttttagctctcgcccattaccgtagcttttctgcagcggcagatgcctgttatatctcacaatcctcattttcaaaacgaatcatgcgtttagaaaataatcttggggtaacactctttgaacgctcaacccgtcaagtatcattgacagaatacggtcagatctatttgaaatacgcccagcaaattaaaactttatcacgccaagcaacggatgaaatcaaccgacgtcatgccgaagacgaaggtattgtcatcggcggtattccatctatcagtgaatatggaattttggatttgatttcaggtttcataaaaacaacccacattcactgtcaggtaaagtctgccccttccgaagatctagaacccatgctactcaatcagactctagacttcgccttcattaaagaagttcaccacactaatttattttatcaacttccctatgctgaggatcatctagttgctgtcctccctgctaatcatcccttagcaaacctatctgaaatcaagctacagcaactagcgaacgaagactttatcttccaaccagttaactcacgaccatatgaactttgcatgatgatttgcaaacaaaatggttttacacctaatgttatctacgccgatcgtattattgaaaatattcttaactttgttaaaaaaggactaggtgtttctttgctcatggagaaattggttcctaaagattctgagttgatctgccttcctatccaccccgcagtagtagctgacatcaacctttgttatctaaagaaagaacctttaagtcagtatggttatgcttttctgaattatttttcacatcaaaataatgctcgctaataaatattgctaaggtcatgattatatttcagaggaagcgctcactaattggtgcaacaaggagccaaaaaacttgaatctaatcttgaaaaattaaatatccagataaaaattgaaatttctagctaaaattatttcgaagcgacacgtcatagatgtaacttatacaaaaacatcaacgatttcttcgacaactagtctggctgatttggtcataatcacatagagacgaaaacagcagtaaacacttaggatttatatgtgtcaagcaaacttgttgactttgaagttacatgtgataagctaattactgtaatttttattgctacagcaatttgaaaggatgttttaattatgaaatacgccatcactgccgctactggtaaatttggtcaaagcgccgttagtacgctgaatgctaaagttggtgcagaaaatgttttagtaattgctcgtaatcaggacaaagctgctcagctgtttcctgataatccaattcgtaccgggaattacgatgatgtcgactcaatgacgaaagccttcgagaacgttgaacgcgtgctcttcgtttcatcacaacctggtggtcccgttgaccgggccaccgctcataaaaacgtcgtgactgcccttaacgccgctcatgttaaatttgtcgcctacactagttttcccaacgcacaggcagcagtcagcgccttagccaatgatcatcgggccaccgaaaatgccataaaagcgactgatattgcgcacagttttcttcgtaacaactggtatttagaaaacgaaatgggcttcttacaaagtggtgcccataaccaagaaaccttgtactgggctaataatacagctggctgggccttggaacgtgaatatgccgaagcggcagcaaccgttttgatggcagatgcccctcaagaagtgtacgaatttgctgggacacccctcacttatgccgcactcggtcaagcactccaagaagcaactggcaaccaagttaagattacccaagtcagtcaggatgcgtacgtgcaattccttgaaacgactggtctaaatcatgataccgctgctttgtttgcctcattccaatccccaatcaatgatggtgcgctggctgaaaagtcagccgacttagctcatgtcttgggacgtcaaccattggaagccagtgtagctattaaagaaatcttagcgcgctaataacgagctagctgtaagtttctcttaaatatcttctacaatacgaaaataggaagttcaacgaacatggcgttgggcttcctattttttaatgattcgtaaatggccttttaattagcgcgtaacatcagcaaaatactgagctaaggttagctgaataccattatgattattatcagttgttactatgttcgctgcctctttaacgggttgtggcgcattagccatcgcaacaccaatccccgctgtctggagcatcgcaacatcattaaagttatcgccaaacgcaatcgtttcagcaggggtaacttgatcatcctgtaataatttcattaatgcggctgctttagttacgcctgccgcaacgatttctaaataagtttctttcgaacgataaactgctaagccgctaaattcatcacggcttaatcgttgttcaatcgcctgaataatatctggatcggccatgatcatcattttatgcactggcgtcggcatccgttgcaaccatgtgcccaaatccgtgacatggggtgcataaccaattcccgtcgcttcctgctgttcccacgggccattagtagccaccaaccagttattattcgaataaatactaattgaggcagctggccaatcatgagctactaccgtttgcacagcttgtgctagtttagggtcaacggcttgctcttcaaaaacagttagtcgatcattcacatcggtcgtagccgttagcgcgccattataggcaatcatggtcgaattaattcctagttgttgtgcaattccaaacatccccttaggcgaacgtgctgaggccaacaccatttgtgccccccgtgcaactgctgcttgaactcccgtaattgtagccggtaataactgtccttgactgtcgactagggtaccgtcgatatcacttacgattaatttgatcattgattttcctccgttaagttaatcatggctatgctaagcgtagacttatattatgtatccttatagattctactgtagcatgaatcaagtcataaataagtattccagaccatttttcattcatagtaaagtaaaagaaccgataacgttacttgttatcgactctttttacctaaaatatcaaatttttggccagggcgacattaccaatcgttgcagaaccattattagcaattcccgttaaaacaatcaaatgatctaagttcggtaattcaacataattgttattaagctgctcaacgtctcttctaatcactggaagttcagtttcgcttactactgagccaccaataacaattctttcaggcatgaaattaagatatgcatcaaagaccagctgtgcaatataataactgatcaacttaaatacttcattggttcgcttcaattgttcccccggtttgccagttcgagcctcaattgcgggtcctgaagccatgccttcaaagcaccgattttgatgatatggacagacacccttgaagttatcgcctgacataggtatgaccattgtatgtcccatttcaagatgagacataccacctatgaaatgattatcttggataacaccaccaccaatgcctgtcccaatagtaaagtatactagtgaacgcactgcttgtccttgtccaatcatatattcaccataagccgaagcatttacgtccgttgtaaaagtaattggaattttcaaagctgccctcaacatctgtacaacatccgtatgagaccaaccagcttttggtgtatttaaaatctgaccatatgtcggtgaatccaccttaatatcggctgggccgaaactcccgattcccaacgcatcgactggatttttcttaaaaaatgaaacacaggcttccagcgtttcatttggctttgtggtcgctactcgttgtcgcttcaagatacggtagtgctcatcagtaattgctaaaatgaacttagtccctccagcttcaatacttcccaaacgcatgagctatgccccctgattgtgtatgagcaaggtaaccatatcataaggctgaatcattaattgttccgaacatggttgagcctcttccagagcatttacctgaatgaaatgttgttttaataagggggtcaaatcagcagccacaccagattcatttgccaaacggataacaaaactatttggcacagtataggccggatacaacgcgctaattgtgacatgtggatcgagtttcaaaaatgactcgcactctgagatagttggtaatgaatcatcaaattcaacatcccaaattttattgtctaatcgatttacaaataaattcaatttttgtaattgataactaacatcgggtgctaaccacttttcagcaattattgccaatttattttcattcaattgagacgtggaaactaacccaaactcaaatgtatttgctcctaattcttcggccaacggcgttggtgtcatctgatgcccaatactagttgtatcgcctgaagcacgacctggtcgccacagtaaattaggcttaccaagttgaccagtggttgccattaatgtgacataaaatgctttctttcctaactcgtattccttcattcctttagcaattaaatacaggccatcgctagccccttgcatcccgacaattttatcaaagttataaaggttaaccggtttttcaacaaattcttcttcccaattttccgcaattggtaaattacgtgttctttgaaagccgccttgaacttgcgcaactgcagtgtcactttcaattgctgtattaatttttaaccgtaatcgatgatctagaacctgattatcgacagttaaacgacctgccaatacattgtcaccatcagttaaagtcaacgttaattcaaatgcgacatcgtgcagctttggttcgtgactaatcctgtcagccaagccttctggtaactgccacttgccgcttaatcgcagttcttgccttccagctccaacataaatggctacaacgccggctaaaggcaagtcaacctctttgtcgcctcgaagcggtgaataatcgtacgtatcaccatcattacccgaatctacaatactaatgatgtttttgtaagttttcccattagtagttgcctgaaagttgccatcgacataattcactttccaactttcattttggatagccgtttgttgctcagactgtaattctggcaaagcttctgcaccatccttaaagtcaattacttggtagcccaacccatcaaactggactgcaacttgtacttgtaattcatagtaaccaggctcgtctttaaattcaaagcctttagccgtttgttgcatgatattttctcgcttagccacataatttgcacttaaaatagttgcttgatatttttcatcaaacataatgtttttcgatgatgttaagaaacggattttcttatatccattgaatgggcgtggatcagtattgaatacaagcacctgattggcatccagtttcaaccgttgtgcgattcttttcttgatatagttttcgataccgtctgcaatttcaaaaccttgtttgaatcgatggtcaatatcaatagcaacattatcagaaacactgccacccaaactgtcatgcggttgacattctagcaactttttccaaagtttcaaaataagacccttagacacatcgataccacatcttttggcgatgaccatcagtggctcaacacgtcgtaatatttgctgttcgagtttgaaattctgccgtttaatgcgcgaacgtactgaaccaattgtccgatgaactctagcataagttggataccgcaactcgccttgataatccggtaaatcattgcgttgtcgtaatgttcgcataaacttcggataattgctgatcacaatctgattatgactatatttatttatcttactaatagtctcagatacgttatgaataatattcatttgatcgattcccgaaggcactaggaccgaattattttgaccctgttgactttcaaaatcaattcctggatctagacggtttgcaacgaactcttgtaagtttttcttcgaatccaatgcgatttgaccagtatagtaacctaacggaaaattagcagcatagacttgactatgacctagactgtgccatttaaaataaacagaatccatttgtcgcttaaaattagtgccccgccaaaaaataaagtcattaatgccaacttgatttaagagcattggcaattgcgaattaaatccaaaagtatctggcaaatagccaatcatcattggttgcccatacttttgtttggtatcgttgatgccaataactaagttacgaataattgattctgcatcaggtatcatcgcatcagtctgtgtataccatggtccaacaaataattgattacggttaattaatttctttatccggataacatcttcgggatgcatttcaacatactcatctagtattgatgtctgtccgtctaaagtaaaattagcttcaggatgcgtttctaactccttcaaaacatttgagaacagctgatcacttagcacctgtgcgtcctcagttgtaaaataccattctcgatcccaatgagtatgatttacaaaatgtgcttttgtcataaatgtatcgctccctgttattttaggtaacaaaagccgcactacggctctttaaccattatgcggctcgttttagtcaatctaagcttcaaaattaatgttaatgtcgtcctcattatcatcagtgacttgttcttcgctctgtgtttggttaaagtccacagccaatggtgccagtacaccgataatcgcagcgcaaacaattagaccgattaaataggcccaaccattcgtaatggtgacaaatccataaaccccaccaacaggaggaatcttagcctgagccccaagtaaaatcgtagtcgccgaaccagcagcaccagcaatcatattaattggaattaatttcaacgggttaactaatgtaaacggaatagcaccttctgttattccaataaatcccatgaaccagtcgcttcgtccagcatcaagtaattcatcagaaaaacgatgcttaaagaaagtcgtcgcaaatgcatatcctaagggaataccagcaatagccacattaacgatcattgcaggggtgtaaatcttttcagctaataaaacgtttcctgccatccatgcagccttattaacaggaccgcctaagtcagaaccaatcatagcgcccatgataactgctaaggtaatagcacttacaccgcttgtactcatttgtttaatccaggcgacaagtgatacattaatccaagtcagcggttgcttcaaaatgactcccatcaatattgccacaaccattgtagatagcagcggtacaacaactaatggcataatagattcgaacttttcaccaacatgtaacttattgtgacaccaacgtgcagtataaccagctgcaaacccagcaaccaaggctcctaaaaatcccatattagaactagatgctaatgagcccccaatgaacccggcggctaaagccggcttatcgccaatagcatatgcaatgtaaccggccaaaactaaattaactaagccaacaccaatccaaccaacggcttcaatttgtcccatataaaaccaaaaaccagttttatacgcatcaaaacttgtaattccaaaacatagacctatcaacttaggaactgcaactacgagggacccgccaataacaaccggtaacatatatgaaataccagacattaagtagcccttccactcagccaatattttcttcataactcactcctccattcttcattaagttcattttatttaacacgagcagcaaccgctttgctgaccttatcaataacagctttcggctttttaatacacatattaatatcaactcgaactgctggaatcccttcaaatcgatccatcttttcaattttttgatccgaaccaatcaataaaaactttgcgcttttcgcctcttcaactgtaatttcatttttaagtcccattgcaccctgttgttctactttagcttgtaaacctagttcctgcgctgctttttctagcgctttcgccgccattggtgtatgtgctaaccctgctgggcatgatgtaattgcaacaaaatccatatcagtcatcctctttttataaaattttttccgaactattggttaatacagtgtaaacatcctgaactgtttgactttcaagtaatgcttgacgctcactgtcatccactaatgcactcgcaaagttagctagaatctgtaagtgtgcctgctcactattttttggaactagcatagcaattacctgattaactggttggtcatcaaatgtcggccaatcttgaatgcttgttgtagagcgaatgaatagtacagcaggttgccgcagatattctgagattgcatgaggaatcgctataccgtcctgcattcctgttgaagcttctttttctcgttgatacagcgctttcaaaactgcatcttcgttatctgcaaagccaagttcaattgctttatgtgcaataaagctaaaaacatcctcacgtgttctaaaatgttcttttaaaaaaatatacttctgtttaaaaatttctgtcatatttgcatttccccttcactgctgtgctaatgtatcaataatttcttgagcattttgagcctttattaaggccgtcattcgctgcccatcttgaatcaaattatagaaataactgtaaatatcatccatttgtgtttcaaccgtgcgattcagggctacgaaaaatacaacatggacattttcgtgatcccatttaattccctttttcgacgtcatgattccaatcgttggttgcaaaacatggtcgatatcaccatggggaattgcaaatttatcgataatggtggatgcaacttgttcacgtgctaacgctgaattttgcatttgattatcaacatacccatacttttctagccgatcagttagttgaataatcgccatctttttttcagttgcctttgaatttgtgataataccgtttggacttaataatttaacaaatgcgttccgcgcatacttttcttgacgaatatcttgacttaacttttccaataagttgagttcttggtcattcaaaaacggactgacttgaataaccctcgtaccgctcatctttaacgggatagtcgaaataataatgtctgcagtcactgttgaagtcatcaactcattcacagacaaagtgccaacaatctgaacatccggtagtttgtccatgacacgttgctttagtaactccgccgtaccataaccagtgctgcatacaattgcaagctcaacatctggttttaagacctttcggcgctcaatgaacgattcaaagtgcagtgctaagtatgcaatttcatcctcagttagctgtaaatggtattgcttttcaatcgccatcgctaatgctagtgcttgatcaaaagcgacgggaaaatacgttttaacttgattacaatacggattcgtaatactaatgccatttttaatgcgaaccagcgctggacgtaagtgtagcgttagattacgtaataattgattatcataatccgttagcacgctacgtagccagtcgactatcgttcgttcaactaagccacttctatccagatcaatgtacccatcctcaatggccgcgacatgcatatttaaataagcaacttcttcatcgggaatttcacacttgaaggccacgataagcattttaactaatttgttggtactcggagatattgccatagtgtcaaaattctgtgtcgtcgtttgagtaataaactcgccattcttaattcgctgaatcgcaatagttgtatggatcagtaaagactcatattgatattcatttacatcaacttttaaaatcttcacaaatttattcaggactttttgcatctgatttaaggtttgtttattgacatatcgtttcagggactgtggcactttaaatgtgcgtgtcattttgccagtctgttgattttgcttaatctcttgtccccaatatgactgtaatagctgaccaatcactcgacgaacatcactctccgaactgttgaatttaacgccttctgtagtggccgtcagcttcaacccataatccatttttaaaacatttaaatcacgttccaacgtactacgactaataaagaagtggtcagcaatatcatctaataacactggtttagattgctgtgtcaagaatgtcataatgctaattctgcgttcttgctcactttggctattatccttcagtatcggaaactcagccaacagtcccttcgtattaccactaaaacgaataccctgtcctcttttcctaacaaggtgtacaccttgttggttgactaccttttccacctcattcagatacttagcaatcgtcttacgagatgtgcccgtatactccataatatcttgatagtgaactatcctttttgacaatatcaactcaataatcattcgtgtaagagttgctggtgaactattcggcgccaaatttatcactccctaacttttacaattcatatgataatgtaaccgtatacattatttaagctcataaaagtacacttgtagctagtgtacctttcataagttattattctttgtgctgtcggccatatacttgaagattgctttagaagtttaatctcgaatcctattgtgactaatattaccccgattttgcgcgttatcttacaggaagacaaatcatttactgaattaattaactattgatatcaatcataaaaaagcagcgtgatttcattatcctgaaatcacgctgctaagactatccaattacaatattcctcagaacagtctagtattaactctcattatcaaatggtgcctaactatctggtctcgaattatccttcaattcaaacttaactttatcccccacgagtttgacaaatagttcctggtcaggctgaggatcaaatggtcccaagtcgacaaggatctgaccattatccgccacttcatatccttggtaacgatcggcaagcagatgatagattgtttgggctggtcgcatccgctcatccacctgagcggccgccgccttcaaggtataaccagtctgcaataaattactcatcgcggctgccttgataaccattttcattgtatacacgcgagcctggcccggctcatcctcgttcttaggaataatgtacccctttttttgccaataccgtagttgtcgtggcgagacaccagtcattctgcttagttcactaatgccaatagttaattgtcctttatgaaaaagctcacgtaaatctgcacgcgtcccgttagtcatactggcgactcccttccaaagttgttattgatataaattatagcatggaatttcgtcgcgaccattaactcgcttggaattttccgtgattaattaacttttctgataatttgtttgtaagtaatccagcaatgactgggcgggacgatccataatcagctgataatcatcacttactgtggctaatagtccgcgggcgccaccggcatacatcgaggccaacattggcccctcaccattctgattgtacatatcgctgaaggcttgcaaggacactggtcgatacccgattggttgcccgctcacttgactaagcacagtggcgagttccggcatcgtgtaagctcgggactgtgttaacgtatagattcgaccacgttgtaataaatcaggcgttgtggcgactttagcaaaagcggccgcactatctgcctgactgatgaagctgagggcctgatcagccattggataaacgacgttgtgccgttcaattaattctggcaaatatggcactaacggatccgcgtaaagcgcattccggaccatcgtatagttaatatcacttccagctaatcgccggggcacgtaaccataaaatgctgataatgcaaatggattattcacctgatcggcaatgaaacccatgactaggaaatgatgcacattcgcctgttggactgctgctaagacgttctcaaattcttggacccgcgaataactatcatgacttttactaggaatatagatcaggacatcactgtcttggaaaaatgcgcgtaactgctctggctgctggtaatcaatagccgcaatatgcaaaccttgttgttggtatacctgggccttactgagtgtatggacccctaaatataattcagtggtggcgactaacggtctcatcgcggcaacaatctgttgtcctaaatgaccagtggcacctgtaatcgcatatttcaatttaactcgccctttcatgtaactttattagttacatttaactaaatatcgatatatttgtcaaataaagcggccgcttatgatattaacgtcacccattgccgccattaattcggaaacatttcgtcgctacatcgttaaaattaaatacacagaaagggctaccctcattacaagagcagccctaagaaatgcttttctaaaaatagttaagccctaatttgcaacctgttgaccaaggtgcttcttttcaggcgccttcttaacgtttttgacatcattatcggaaaagccaaacatccacgttaacgtaaaggcgacaatcaagtcgatagcagaggcaatcaagaaaccgtagaaactaaaatcaagccccttaggattgataaaggaggtcacaccgatcagtgacccggcgaagccccacatgttaacgttaaacagtccggtcaagaaaccaccgacagcaccaccgatacttgcagtaataaatgcccggccgtatttcagattgatcccgtacattgcaggttcagtgaccccacagaaggctgagatcgttgctggccaagcgagctctttaatattagcaaacttagacttcagcgcaattgctaagaccgcgccaccttgggcaaccatcgttgcagaaacaatggcattcaagtaactgtgcccagttgtcgtaatatcgttgacaacaattggaataatcgcccagtgtaacccgaagataactaatacttggtagaagccaccgataattaagccagagatggctggactgagtttgtaaatcgccacaattcctgcagccaatgcgccagacaaagctgtaatgattggcccgaggatgataatgatggctccagaaataatcacaacttcaaacaacggtacgaagatcatccgtaagactgttgggatgacccgcttgagccatggttccaacttacttgctaaccacgcccccgcaatcatcgggaaaatcgagtaggtataggaggcaacgtgaaccggaatgccaaagaagttcgcattgattgccattcccaataagtgacccgtaacctttccggttgttgccataccaacaattgctgggtatgttaagaccccaccaataattcccatgataaccggatcagcccctaacttcttggctgcggtgaaaccaacaaatatcggtaagaagtagaagacggaatcacccatcgcattaataatcacgtaggtcggcgttgtcgcagagacgaggttgaagttctttagtaacgacaaaatcccctttaagatcccagaagctgccaacaacccaatcactggaatcatggaccccgtaataacaccaatcaagctgctaaaaccgtgtttgaccttctgccacggcgtcattttctgccacgctaaccggttcgcttccttctccatcgcaacagccgaagcgtcagcatccccaaagcctgcgcctagttgacccacgattgcatcatacacgtcggtcaccgctggcccaatcaccacctggtactgaccacctgcctttgcaacatcgataacgccctttaggtttcggattgcctcgtcattggcctgcccttcgtcctttaagtaaaatcgaacccgggtaatgcagtgaatcacgcttttcacatttaccggtccaccaacttgagcaatgatttgagtcgccaattcatcgtacttgccgcccttacccttaaccaccgatgcttcggcaacgtgttctttcaattcaacaacagcaccgacgaccccggcacggacttcacccagttcgggcgttagtttggtaaccatatccgccgtattcgttacggccatgattaccgtggtatccttgttcgcactagtaatcgccgctaaatccattacggccactttttcgccggcctcgaccgtatcaccaacttgcacgttaactttaaacggtggccgatctgctagttcgaccgtatcgataccaagatgaaccaacacttccagaccattgttccccgtaaagccaatcgcgtgcagactcgctgcaaccatcgttactttaccactgattggtgcaacgacctgtccatctgtcggttcaataccaaatccttgccccatcatcccttgtgaaaacaccggatcgtgaaccgattcgagtggcactaactgtcctgcagccggcgttaataaatgcacttgcttcatagcgattctccccctttgactaatcaataatcgcgttgttaacaaactaatttcggacactggttgttataaaatcactaataattgccaatccatccagtgaccaactgtcaggccctcctaactaatcaagtaacgtccttaaccataaaagcgctttcttttataaacataataatagccgcccctattaagtcggtcaataaaacccgattaaaataaggcggttcacttgaatttaggaacttatttaattagcttgccaaactttgtgaagcaagtgttaatcgttgcgttgcaagaaaggaccgttcgaaatcagccgtcgttaaatcataatgccacgcctgcataatcagttgttgggcctttaagtagttactcggtaacggttggttaagccagccgaataggcgccgcaaatacgtgtcgataatgatcgttggctgatgaaaaacgtacatgctaaagtagtcagccgtttcatcgccaataccgcgcagggcgattagttcacgccgcaattgttctgctggcaaggctcgcatcacggtcaagtcaaaatcatactgtccacaccacgctgctaaagcttttaaagttggaactttgcgcgtatagaagcccgcgggtttgactaaagtcgtcagttcagtatcagtcaatgctagtaactgccgaggctcaaagtcagtggctgcttttaaattagccagtgcgtaatccacgttgcgccagttggtattctgaacgagaataccgccccagagaatctcccaaggcgtctcggcaggtgggattccggcttggagccagtgccggggccccatggcagctaacatctgctgatacagtgtctcaatggtcattgttagccctcctcacatgaattgattaatgttgagaccaataatttgatcttacaaaaaaatagtcgtaacggcaaaacatcaatccgctacaactattgtttacgcttgtttattagtcatctaccaccgtactgcgcttaacagctagcacaatgtcagccttccgattttcaggcttgatcttttcttcaaagtccaattcggcatccttaaacaggttctgaatctcagtattaactaacgacaagtcgcgtgaatccccagcttgttggcgaatatagaccacatattgatctggtaattcttcaagatcatattccacatcttcgtcattcaaaataacataaatcaacttacgttctttgttcatttgaaacttccccttatcaattattttatccgaattagtcgtttgcggctaactggtgagcaaacttaaggtagtcagccacacaatggtctaaccactcaacgaccttattgtccgtaaggtccccatcggcattcatcttgtcctgcaccgcgctcaacaagaattcatttccaggcagaatctgcatcccaactccgggtgaatctaaaacttgccgtaaatgactctgcgctcgcactgtccccaagggtcccattgtggcccctaaaatcatagctggtttcccaattaacggtcgttcaacacgcgatagccaatcaatcgcattttccaagacacctggaacactatggttatattccggtgtcacaaaaatgacgccatccgcgtccatgaccgtctgcttaaaggcttgcacctccgcgggggcttctagctcgatatcctgatcataaaaaggcaacgcgcccaagttaggaatcgtgacatccagttgatcggcataccgtttctgaacaaacgttgctaacttacgattatatgaggaacgtcgaatgctaccgacgagtgcgataatcttcatcgtgtgaaaaactcctttaagttgtaattacttttagtataccccttttttggcaaatagtcggaaccggttacaaaaaaccagctgctttcatcaaaattttaatcttaactgctgaatattcagtcagtttagcaattccagtccccatccgcgtaactgccattatcttaagtctaattttaaacgaggtgagacattcattagcgggcctgattattgcttgctcatcgaaataactaccagacataataatcgaggcagtgctttatcgccatcacaggattaataaactttcacaaatgtttcttaacttttttcaaaaccaaacgtccattgttagtgtgatgaatagagtctgctatactattgattagagaaattgattggggggttaatcgtgtattatcgtggtgaagcacttgactttttgaatatgctacatactacaggtgccgcgccattaatgcgttcgcgaatcgttttttccagtcagatcgacgtggaacgcttaaaggctgccgtgctcgcttccgcacaaatcgtacccgagattttcggtcattatcaagctgaccgtaatcgtttcgttgttactgatcaaccagtcaaccaagttattcaggaagttcaaagcccgtatagtcctgaaaacactgattttgattttacgaatagtccgcaactacggttatttgtcattcatcacggtgactacgatgtcttacaagcctttatgagccacctactaacggacaatcgtgggtttaaagaatatctgtacctgctcgcacaagcctacaattatgccgatctcacgaatttgcataatgaacggcgactacgcccagttatcactaagttgcaacgtcaatttgcacggccacacggtcatgcacccattgttaccggtatggttaaactaccccattatccgggaattaacttgcggcacggtggtcacgtaatgctcagtagcacgcaattcatgcgcgtccgacgaatggctaaggcccaagacgtcggtattagcgaggccattttggcggcatacgctaaagcactccaagttttaactggtcatacaaccgtgacattgccgtgcccaatcgacctgcgccgcttcacgactgaagatgcgaacgtcacccaaatcgctaatttaaccgtcaatgtttttctgacaatcaaggtagatattgatgcaccttttagtgagctcgtcaatcaagtccacgacttgttaacggtcgagcgtacgcgggtcgccttcctttatcgacttagcaatttacagaaaatgaaccatacaatgccaatcacggtcatgcgtaaaatgaccaaacgctggttaccacagcctgcgctccggtataccaactttggtgtcgtcgaccaggaacggcttaaatttcatgacttgacggtcgtcaattgcgtcttctcgggtgccttccagtgctcacccgttatggaaattgccgccagcacgtttgccggaacctgtacattgagcttcaatagcaccgggtccgaacgtgactaccagttatccatgaaaatcctggaaaacattcaagctcaactgctagtgtgggcacaagcagatgctcaagtagccacaactgataatgtgacgttgcgccaccaagcataattaagtcaattgataggccttaaataccggccacaaaaaatcccaagctaaatgagcttgggattttttatggccgccgttaatctggctatcagtgtgattatggattatttagaatcatccagctaatgacgactagtcatccggccgaatcgtttccgagtaatgacttaactggtatatcggtgcccgtcgtgccaatattgctggtgctttgtgaattttcactaggcaaccagtttgcccacttggggtcagtcgaacatcataattttgaaaactagggcgtattggcgtagtcactgtcagtggtccaataacgcgctgtaagccaatctgaatatttgctaggtgttggaaagggctcccaactaaattacttaaaaagccatcatataggcgccatagtgccccggcggacggcacccagactggttgtccagcggatgcttgtaattggaatcgtaacgtcacgcactgccgggtcacggtcaactgaatcggtcgaaccttcaaccgagtagtagcggcttttaggactgcaacttgtgccaacgcttggggaacatcatagctcgccgcaaatactgggaactgattagtgggtacctgccgtcctttttccgtagtcgtaagttgccggataactttcatcattgcttcaaggccaagtacatatgcgcgttcgtattggacccgctcaaccggtaatgctggtacaattaattgcgtcattttaccacctctatccacattcacttaattatcgttagtttactcacgtcctcagccccagtaaagccttttcagctatttcgttaattaattttgtcaaaagtttcatctagtaatgtttctaaattggaatccttctaaaaagtgtggtttaataagggtgaatatgataaaaggaggaaccgcgtcgtggcagaagatatgttgacccaagccttgcagcaattaaaggaccataaaatccgtgtaacgccgcaacggcaaatcattcttaattatttgattactcaccataatcatccatccgtcgaaaccatctatcaggaattagcaactcaattacctaacctgagcttggcaacggtttacaatacgttaaaactttttgtcgacttaggaatcgtaattgaattacaaaatggcgatgctggcacccactatgactttttcggtcgaccacattatcacgtcgtttgtgagaattgtggtaaaattactgacgttttcgaacccgacctccgcagtgtcgaagccaaggcggcggaactctctgggtacttggttacgggtcacaatatggaagtctatggattatgcccagactgccagaaactactcaatgtaactaaaccagctgatttaaagcgattgaaattgacgcacagtgaatagaaccagttcaatggcaaccggctatttagcgcgctggttatcctaaaacaaaaggaacactttcagttttcctgtattagtccctgtcaaccttaagcggactatcacagcctgaagtgttccttttaatttatacgataagctgattttacttacgctttaatcaacatcacaatcggaggacgctttcggaataccaatcagcaattacacgaccggtagccctcaaccccctggccggtattaatgttgtgggacttcttccagcatgccatagaactgtgacttgtcagagaaatcagccatataggccccgttcaatccggccttttgcccgattattcctaagtcgatcattagcttttcttcttcatctggaaagtgtaaccgtcccttaatggctacactacgaatatagtttactaggcgattgactaaggcttctgggttcttagtcgtagtaatttttttatcgacctgcattaatacatcaataatatccaataagtcccccgactgatcagaccacccacttaaccggacgattagtcccttaatagcctcttgagcttgttgtcgtaattctgattctcgctgcattaataaagtccccctctatatgattcggattaccataataatttcaaattataggtatctttatatacacttttattatacacgcttatgattgcattcaaaaaaacattcataaacgtgcaaaaaacgcccatcaacgtaaaaaagtccgagctttcacccgaacttaaccccactttaatttactaattaccctaacgttcctgtccaaacgcaaaatagagccacggtccaaatggttgtacaaaggctaataacaaccagccaagtcgatgtcctcggcgaaatgacttcgccgtcaagacatccgcaaccacaattgtggttgcggtaatctccatggcggcaacgggtaacaaccgttgctttaatttacgtttgatccgtggtggcatttgattgtgatgacgaaatagtcccatattgacgcctcccttaattattaccaacattataccttgttaattaagaaagcgctgtcttgattcatacccttgtggggctcgcccgacaaacttagtgtctgggatcgtcaattcatcaataaccgctttcccatgcagtaactggcgcgttgtcacaccgacctgtcctcgatcgattgtaatgatttggtaactactgccctcatgaacataatgatgatgtggatcatggcaatcgatcgcataggccgcagaaccggccaccacattcagaatattatctccaatcaaataacttgaaacaaagtgaacgtgaccagagaatacgccgcctaaattatgtccccgaagcaccgataacagcgccggcgtattttgtaaaatcgcatagtgcatatttgtcatcgtcggcccatctagggggtgatgcaaaaatagaaaagcccgctttgtcggtgcctgtcgtagatgttttcccaaccattgtagctgttgtggtgccaaccagcctgcctcataaccgctaacctttgaatccaaaaaataaaagtcgttgttgccaatccgcatgcgactcgcgtagtatggtcccgggtcagccggcaaatacccttcgtaaaacgccgctcgccgatcatggtttccaaggataactcgaacaagacaatcaaattcagcttccatcgtatggatgattgcgtgcagccgctgataatcgtcagcgctaccgtcatgaatcaagtccccggtaaaaacaatcaaatctggcatggttggtaatcgccgaatatcatcaataatattggcaagcttgccccagggatcgtactgctgaccatgtgccggtacttggccgcggggggttaaatgtagatcagaaatctgaataacttgtaaaggacgcaattcgatcctccctctcatactttaatcaccagatggttatctctaatatagcgagctaacgtaaagttttaccaatcttcatataaagtaactgtaaagtttgtgctaacctctctttacgcaccattgaaaagtgcccccacagcaacacctttcaccaatagttcagccatcacccgtattgccttcattatactgaaaccacattatcggcagcacgtgcccaacggctttactgtaagtcttcagtatatccgcatcttatttcaccgtcccccagagctagttgttcttgacatcagcacttggcacatgccacccgtgtttcatactgagctagctagtctgacgcgtaatctcataatttttggttgacaagcccaccttttgccgccaccatgaagataagctttaataacatcatacgagtgagggattattttgaaaaatatgtttgtcgggccccatgtggcccttgctgttccccagccagaagattttgatgagatcagtgactggtacactgacgccgattttgttcgtaaaatggatacggctgccgcccgaccactgaccggtgaagaactcgaacgaacttaccgtaaccttgatcggaataccgaatactactttcacgttcatagtttagaagacgaccacttattaggctttgtcaccctattcaatatcgaatggcataaccaggttgcccaattagccatcgcaatcggtgatcccgacgaacgcggccatggttatggtaccgagacactcagcttgattttgaactacgcttttaacgaattgaatctttacaaagtctgtttggacgtcatcgcaacaaaccccgccgctatcgctgtttaccagaatagtggttttgaatttgagggcaccaataagcgtgctatcaagcgtgatgggcaacgaatcgacctctatcacatgggcttatttgcggctgatttccagccccgcgttactttaaactaattaatcagctcaattagttgcagccaataacttttgcaattataatagtcgcagattgatagaaagtgaccaactgactgtcaatccttaatattctttagttttttcgattattagtgcgttgctgccataatgcagctaataatcactttcattcatagactcccccaagtctgatgaatggggttcatcaaagcccccactttgatgtttcctactccttgaccactacatccgctgatgtggtggcttttttattgccgtctaaaaaagccgtcatgggtatgcaatccccacaacggcctgctattatcttgtaatagccaaaacaagcggttcaacaactgcctgtttcgattagatccaactggtacccaatctactcacgagtaaattatgtgccaccaagatttaatcttcttccaactcaacattgctgttcgttcgacgagcaatgaaccattccttgacttgaattaaaacccacgcgattcccgctgtaaaaagcaacaacattagtgtcgaaacaataatgacgatcacaatctgaacgccttctgcctttaacacgtctaacttagttactaacgcgatccctgatggaatgaaaatcaagctgataaattggacgaaaaagttgctaacacccgccacctgctcaagtttgaccactttaaacgttaacagcaagtatagtagaatcatcccaatcaacggtgtcggcattgggaatgcgggccaaatcttattgactaaattagcaattaaactactagccaataaaatcaaaccataaatcacaatttgtgtaataaacgcgccttttttcatcgaatccctcccggaccatctaacctaaaccaatcaactgcgcaaaccctggaaccataaaattaacaagaataccggcaatcacaaaggcgattgcaccagttgcgcccgcagcctcgctcacttcaatcgctttagtggcaccaaccgcattaccggcaattccgaatcctaacccggcaccgagcggattcttgtgcaatttgaaccagcgaataaaatggtcgcctaacgcgtaaatcaaaactgaattcagaatgactgcgaacgccgcaatggcttgatcgccacccaccgactcagccaccggtaaagcaattgctgtcgttgctgcttgtactaacatggcacctaacgctgcatccgtcagaccgagcaaccgtgaaatcccatagataccaaataatgacagccctaacccaatcgctaacgcaatcacaatgacatcccaatgtttcttaaagatatcattacgcttatatagtggcaccgcaaacgagacggtggcgggcgccacaaaccagaataaccagtcgccaccaacctggtacgcttcataaactttttgcacgggtgcctttagaatcgacgcaatcaataccaataaaccaatcccgagcagcattccaaaaaataacggttggaataacacaaagcgatttgttttgtgatataaatactcgccaatcccatacaccaagatcgacagtccgatcccgaaaaacggattattgagaagatagctcacataagttcctactttcttttagtgaaaagagtgacaaaaaaggtgccccatccgggtctagtcatcattaaatggtggttaggctcagaacagtgcaccaacacggttctcatttatcattaattaattataacacatcaaagtaatttttaatagtaggttagttcgtcaaatttaatcaactgtataaaacatcaatgcgtaagcgccaacaccggtgtgcgtcgcaataattggactagtacgcgcaaccagtggcgttacttgtggaacgacttgttggagaagcttttctggcgcttccgcaacgctcggttcgccgacgtaagaaattccagccgcttcgactcgagtcgcatccgctaattggtctagaatttgttcctgcgctttgattagcgcctttttcccgcgcccccgcgtataaagttttaattttccggcttctaattcaaagacaaattttaatttaatcaaattcgtgaccatgccagccaacttagggacgcgcccacctttgaccaaattgtcgagcgtatccacgaacaagtaggtcttagtatgctgccgaatgacggttatcttcgccaaaattgtggccatatccgcaccggcgtgagccatccgtgctgctgtaagcacttgaaaggccatcccacggtcagccgcctgggtatcaataactgtcacatcgccactagcaagtttggcagcttggcgagcagcattgaccgtcccactcaatgtctccgtcaaatgtagtgataatacttggctaccatccgctgtcaattcatcgtagcaactgacgaaatcaccaattggcggctggctagtcgttggcaagactgggctgactgccatctgttggtcaaattccgcggtactaactgccgtatctgcaatcaagtcgccaccgaaccccacgagtaacggaaccactttaatattatactgtgcaatctcggccgtcgttaattggaccgacgaatcggtgacgattttaattgtcatatttggaaaacacctttcgattaatttgtgcttcattatagcacctcagagtctaggaccaataaaaactgcgtcacaccagcatttagccactcatattgatttatgacggtcatcatttcgttataaactttgtaaaaatcgtcatattttttcgttccatgacctaactttttcgtctgaaaatcatgcttttaaacttttcgcgtcacactttcttcacgcgtcgccgctatactgtgtttatagtcattaaggaaatcccaatccttaacgaccccctaactttaatgattacttccccaagtaatgatgtgtgtgtacttaattacattttaccgatttacttcccttttcctccgtatttccccgatacggaggttttttattgccttcaagcagttgtggctcacgcgtgaacaccgtattaaccataatcattgccaatccaatttccaccataaaaaacgcgccaaggcgagaaacaaacttctcaaccttaccgcgtatcgtggtcctaatacttatttcatcttatcgagatcttctggtgcaataaaaaaactgacctgtcccgtttctaaatcaacgtgcgccttcacttcaacacctttaggaaaaatccagcctttcccagtatctaactttaacggcatttccccatacgttttggttcgatacgtcttttccatcagaaaactccttcgctctttgccaattacgattaactgggctaattatataatctgacgtcgtttctcgatagtaaagacactttccaatggctttcttcagtaggaatgtcacgctaaatctgatagaatcggattaacattaaaccacttaggaggggtcgaccttgttctattcgttttttgatccgacttacctattagtcatcattggactgatcatctcaatggccgcatcgggttacgttaatcggacattccggcattatgatgcctatcgtagtcaatctggcacaaccggcaccgatgcagctcgctttattttaagccaatctggtatcaatgatgttggtgtccaaaagataagcggggatctgaccgacaattacaacggtcaaactaagattctcagcctatcagaagccacagcagattcaacctctgtggccgccatcggagttgcggcccacgaatgcggacacgcagttcaagatcacgttaactattggccaatgcgcttgcggaccgccctcgtgcccatcacgaacatcggttcaagcttatcattaccactaatcattatcggcgttttattgagttacaaccaaacactgattcacattgggattttactcttctcactggcgttattgttccaacttgtcacgcttccagttgaattcaacgcctcaagacgcgccctccagattttatctgatgggcaagttttgactcgcgacgaagttcccatggtgcgtaaagtgcttgtcgcggcggctttaacctatgttgctgcagccctgtcaacattcttacaattactacgactaattattctatttggtggtaatcgtgacgataactaatcgtgccaaatggcagtgcccacagccagtcaccaaaatctgcttggtcactatcaacttagcgtcgccgcaaacttgttattactagcattgattgcgaatcaaaatagtcacttcaaaggacaacttttgaagtgactattttctttggccccaaacagccgatcatcgcacctcgccaaggcattccgtaagaacgttgatgattcttcacacttcttaataaagcctttccctttttttcatgacattcgccatgttcagtcacaaattcttcacacaacctcggtatgattacatcatagcaattgaggttaactcaatcagctataacacaacctaaaatttttcatttactcctccaaagtaatgaaattcatagtaacatgtgattccccgtcacatgtttaccctactcctttttccaccgtattccccgatacggtggttttgatttttaagccttttataggcttttagaagcccgtaaaatagggattcttaaatttgtttattttaaagacgtataatctccccacaattgggggaacttttgggggagatttcaagcaaagcgggcgacgccacacataaaatttttcattcgagtaggtaggactattttgacattatttttgaatgaagtataatacacatattccatcactctggaatatcaacttttcttaacattgggccggtcttgactggtcctttttatttttatatttctgtcaacaaaaaactcctactccgaatattatacagtggttagctactaatcatagtaaggtttcattgtacgatgtgcacaaaaattcttagataggtaatatataaaaatcccctacgtggatacgcagggaattcatcaagttataactatcatctagaaactatctagagacagatattattatacttattgcttactactctgtaaaccctagtagttgtctcattagctatattgacaactaattatgctaaaactaaaatcgcactaaccaaatacacgggtaagtaatataaaaaaatcttccgcccatcaaagcagaagattatcctcatcacctctggcatcattagctgacaatcctggagggattcgaaagccatgatactaataacaggacaaaggacataataacgcttgtcagtttatattacaataccgaaagtagtctatacaaacatattaataagtccttgtgatatttatccactttgaggtataatcattattgttcccttcttaattcctagggagtagaacacccattttatttatttaaaccttgaaccagccttggctggttctttttgtatatttctgttaataaaaggatcccccacaccgaagcatgggggactagaacagttcacgcttattatactacttttagcttgcttgtgaggcagattctgacgccgtttcaacatctgattgcgcattgctatccaaattagccgctagcgatgacgctaaagtggctgctgaactagccgtgaccgtgtcaccaactgccgccgcactagctgcttgactatacgcggccactactgcctgtgatgcttgggcttcagcttgactagccgctgctgagttagctgcttcaatcttagcttgagcttctgccaaggcttccacgaccgcttgttccgtagaagctaatgtgttcgacttagtcttgattgtgttacctgtatcttccaaaatagaattatccgtaattgccccgacaaaagctaggattgcccctacggcggtaatcactaacacaactgcattagcgtcaatcttaacaccaaagaagaccgttgcgacagctaagccgataatcaacacggacccgataatctgggcccaataagcaggctttttgtagttagctttgagtgttgcctgaattacatttaaaaattttgtcattattttccctcctaaaggaacttttctgcgatataaataactaacgtgacaagcacgccactaaccaagacaccgatcagccaattttgaatagttgtaacacggtcaatttgatggctagcttcgatggacttggccagtgccttgtccgctttgtcgccaatatcgtcaacttgattcaatttttcttcgatgttctcaactttcgttttggtggcagccacatccttttgaatatccattaataacttagttgtatcgtcgtattgtgccatcagtagaccacccgcttcccgtagtcatgcccgttggtgacacctagcttgataaagccatataggccatttgaacgggtgtaacgtgcccatacatagtcatgctcaatgataactgcgttgtaaatcacactctcacccttgtaataggtggctacttggctaactttgtcattatctgtgtaacgtacggccagagtccgattaggatagaataccccgcgctggttgtatttaacaaccttaaaggtggccttcttagctgccttaactgactgagcctgcttaacgttagcctgtgctttagctttgctagcagtcgtgtagcctgatttagtgatccctgttaaatcaacgttgccgtctaatccttgtggaacaccattcacatagccggtaatccgatacatactcgtaaactggaagatagccacgccgtccattgatgggaaccagttgtaatccggcttagttctaaccaaataatccggatactcagctagccatagacagctaccataggtacgtacaatggcactcacattaacatgtgcacttagataatccttaccaccataaagcattggggaatagccagccgctataattaacttaaattgagctttaatgacattagtgttggctgtcacgctattagaagcaccgtcctcatagtccaacgccacaatactacccttgggcgtcttaacgcgtggcaaataataggccatcatcgccttggcgttggtcatattgccaccaaccccgtcccataaataggtgtgcacccgtttaccagcctgtttagcactggcaacttggctgttataagtggtctgaggaatgttagtcccaccataaaagccacccgcctgtgagagtacgaacttatcggtactatagccgaatgtcccactattgccgttatacttagaccagtcgaccccttggtcacgactagttgaagcctgactgtttaaattgaccattaaaaaggccataaaaatagcccccaccattaagatgagcgcctttaacttgtgcttattcaattgtctacctcctattcaagactactattaacttggaactgtaacgttgactcactcgggtaaattgacgttccggtactatcaaccacccatacttctagctgataatctcccgctgttaagccggtcattaaatccgctgttaaagctagcacaatctggccagtcgttgggtcggttaaactagttgggtcaactgtggccgatttaagatagccactagtattgcccagtttaacggtaattgacgtggcattagttaagtcagtggccacattatcattgccacaaattaacgtaaagctagtggtggtatcgccaattttaaccgtttgtggtgaagtatcggtaaaactaagcgttttcgccatctttaggtgcctccttctcggccaactcggcattgagctggtcaatttgaacttgagccatcgctaattgctgatccttaacggcaattgcttgggcatagttactcgtcatcttattaattaaagcctgtgcatcgatattcatattttaagcctccttagtagtggttgtagtaactggctttaaagcagtcaggctatcaatcagcgtgtttaacacctttaatttaaccctatcagcgcccccagcacctccagcaatggcattgttaaactcgtccatggtgatgctgacctgtgaactaatacctaaagtgttaatctgaatgctgattgtcataatgttgttcgtgtaatctggtttataattcgtaatcaaaatgctatccatttatctttgcctccaatttgtttaatctagcttctaactccatgttgtgaccgtttagttggtcaatttccttttgttgttcctgcaccgtggctagggtggcatttaaaagcacgctgtcgtccaccccacttagcttgccgttttcatcacgactgataaagacgtctggcaattgccactgcttagtgtcattcacatcatcaacgattgaagacaacctaatgtggctagtattatcgtcagatttatactgataagtggctaagtcaattgagttaactagctgtgcccaataagctgtatcagcctttttaacgtcccgcttaacacttaatagggacgatttaactaagctagtatagtgaacggcaccggcataaatatcagccgcgccacctttacccattgcaaagtgaatagcttggttatcagcactggtaaacgtatgaccggtgttaatatggaagttaccaatatccaactcacgatgcaagaaaatattgttagcaccggcagtgtcgataccgaagtcaacaatatcattgctattagtatctctaattcgccaataagaagaattcgcttgtgcatatatgttgccataagcatccatagtaatcccgttactgccaatattatcggcattaccagcaaagtttattttttgtgttggcccgtatagatagattcctgaggctggtgttacgttaacatagcccgtgattgtctccggattggaaaaagttgtatctttagctgacgtataacctgattgtgactcaaaaccttgaccgttaattactgaatcataagctaagtattgcccactgccgatcattgagcgatatttatagctaatcgccccagattcaacgcttgattgcagtccaaccgcactgtcaaagtacgtcgacttatacgccccgtctggcgtaatagtcattggataatatttagcggtgttattggcattgctaataatgtcgccaccatggaacgttgtcccattaatggtcgaaccattaataactgagccatctatttcgccggcactaacaacattacctgtatctggctggtagccagttgattgagcagtttgtgttagcataggtgagctaaataaggcgtgtccagtaccgttgtatgcccaatattggatagcaacatagacagctgtacttggtgcattaaacccattaatggttagatacttccacgcctgggcactaccagttccagatacttgaacgccagcatagtttccagatggtagcctattaccacttgcatcaaagaaacttaaaaccatttgatatctcatcgtggcatcactaccagcgtcaataaaccaaactgaggcactgtaaggctgaccggttaacccgtttaagggataaagcttagactgtgcaagtcgttgccgagtggaagcacccgtactgccattaaacccaattgaagggacaccatcatgcaacgtaaagtttgagaagtatcccattgtacccatcgtccaaccgggaatgctagagttgctaccaccagctccgcctaataacgccgcattataaactaggttagtgacccctctaattgttaaattactagccaccacattaccgtttgcatcggttgtaaatgagccattaggcgtgctaaacgtgttagccacaatgtcgacacctttaagtgagccggttgtaacgtcacctaaattggcacttaaagccgatagtttgccgacatttaaccggtcagtgctgagtgttccagtagtaatgtttccagcgtctaagctagccactgttactttactagcatcaattgaaccagtagtaatatggttagcactaatgttacccattttagcgtcagtgatagcggcgtcagctatctgtgctgtgcctacagctaatgaccctatcttggcattagtaattgcgccatcacctatttgggcggtgcccacggctaggttagcaatcttggcactattgacagcggcattaccaatctgagcattggtaattgcaccattggctatttcagctgttccaataacccctttatcaataaccgtttctgtcgtgatatggactatcgaaccatccttaacacctgcacttagcgtctgataatcagcgcttgccttgtttgcactaactgttgctgcactaccagctagtacagcacttgaagcggcctgactagcactgttagcaatactagtggcattattaccggcactttgagctactgtagccgcactataagcttgtgaagcaacctgactagcattattacccgttgtagttgcctgtgaagcgactatagcagcactagaagccgcttgactagctacagccacactagactgcatgttatcaatgtcggtgttaaagctgttgcttaaggcggtctgtacattgcttagagccgtgttataagcgtctgtgagactcttataagtgtctcgattaacgtcactagctttagtagtatccgttaagatggccgacataaaggtgttcaagttagtgtaggctgtcgttaaagcagtcgtactgatactggcatctttagcccgggctagcaccacattatactggctagttaatccggcatattgtgaagcctgtgtctgtttctcaataacactcattaagtttgggtcatttaaattggtaactccactagccgcattatcagccgtattttgcgcgttgataatcttaatgccatcatcagttaagatgacttgagttgcattagattcagccatctaattcacctcccttctaatcggccgtgctatcattttcattgattgtccctttatcaatcacactagatgccgatcgtttcgtaatgggtattgcgtacaccttttccttttcagccgagtatgggtcaatttctagtacccgggtgttaaaggtcactaacaagtaggcctgtgtgccttgatagaagacgttacaagtttccacttcacgactttcatcggttaggttgggcaagaccatgtcattatcaaagtaagcttcaaactcggcccctttatgcacgacatttaaagcccacactttatgggggtcgttagtagtctcagcttcaccaccaccggccacaaagtagaagtaagggaagtctaggcattctgattggtaggtgttctgattaaaatcaatcccataatcagtgatattaaagttgtatagcacgttgtaattaccagctaacaggtcactagcgttaagaatatcggtgctaccatcgttatagccaattgagaccatatcatgttgatggtcatagttaatgcggccgtatcctttaagaggcataatctgtttcacacgactatcggtaggctgtaaagttacacccggtagataagggaaacgaaccaagatatagttatggtcattcttcaaactcacaatgttccagatatagaccgtgttattaacttcttgtaccccaaacgtcccaccatgttgtccgtgaacctgcaacatcactgactgcacggcaaacttgctatcctgtaaagcaaacatggtatcactagagccactgtcatcacgagcacgactagttaggtactgtccattgcttaaccgggccatatattgcgtcgccgagtgggcaccattatcgtctgggccatatacccctagataactaatcccagtggtatctagcttaatttcagggtaatcttggatatagtcggattcaatcgtcccatgcaaagtaccaacagcgttactagccgcattaattaagtagcccgtttgctgatagctggtgtcaaccgtgccatcggtattataacggcgccagataaagcccttgctgtcaatatacgatgaaatattggtgctaccttcccaagcctgtaagattaagcgcttagtttgggtggtatcagtgaaattgttaccgtcaggcgttaaagcaaccggtttaatcgaactagcatccttcttagcttcatcaactgctttactgagtacgttttggtactgctccatccatgctggggtggctacttgaacggttgtatattccccaaagccaaccgtgttgccatatgggttagcaaagctaattgtccgttgaatcacccggccactggcgtctaatatgggctcaattagttcatctttaaacctgatcgtggcgcctaatggtggattaaagttgggtgttacattcacctcataatatgtccgcgggtgattgtatagcttaagcatgtcctgagcccaggccttcaaaccggctgagttactaatctgattagcggttaccaccgcttcatagtaaaggccagcttgccaatcggggttatatttctggttggcctcatcatcaacaatataaggcttaccatcattgaccacggcaatcgtgctaccgttggctccatagggaatcagcttggtcactggtgttgaaacggttgtccgtttaatactagtcatattcttaccgaataccgcttcgttataaaccacatcattgtttagctggtcagtaatgacacacacctttttcgtgatgttcccttgactatcaatctccacataagggtcaatctcgacatcatacgtttgaatgagtgtctgtactaacgtgctagctttcgtcttaccatcaatggtaatcgatggtgtcattacattggtagtctgatagtctagcgtccaccctgtcgcattaaaacactgattaaaggctgtctgaatcgtgcttgcactggcagtagtagcgataggataatgatgagccagcgtgtacaggcatagattggtaaagttaatagtcgtagtatgtttaacagccgcactagaagcgtcatcagttgagtaaatgtacataacataccaatggcctgatagctcgtcataataggctaagttattaccagctactactttgtctgaatcaggttgaccttgaagcacgtctaaagagccttgatggtcgaactttttagattgggcatttaggttaaccgtgccatcaaacgtgtcattagtgcccacgttaacatcatcgtcatagctagtgctagttgtgtctgaatcagctagttgaatcttgacgctgtcattagagaacttagtggctccatccacggtcagggtaccaatccgctttaaatttgaatctaggattaaatactggttatttaaagccatctgttaacctccttattttagttatgtattaaaaaggccacccttaattgggaagcctttaagtgttgctagagtaatctgggtagatatttaagcgtgatttgggcgtcatctaggtcaccaatcatcgtcaggctattaacccccgggcttaatttaggatagtccgttgaccagattggactagctagcttaccgccaaccgtggtgctatcagtctcacaatttaagacgatctcttgaccagcactagcaatatatttaggtgcgtcctgtgatacgtcattaacttgataaatgtctaggtgggtgattgacagataagggttttcatagcccacattttcgtcatcttcagcaattgagtgcttgaagaacaccccgccgatgccacctaaagccgactgataattagagttcctatcaacaaacgtgccatgcacaattaaaaatcgtttagggtctttacatggttgaccgttgtgactaccactggtgtagtattgggtgattgaccagctaaacaccttgccatttttgattaagtcgagttctagccaactagtgcttagcgccgacttttcttctttgttaacaacggtgatatacttgtcaactttttcattaatcgtcttagtcgttactttaccagtcttcttgttcttcgacttcttgactaccgtcttagtcgtagtaccagtcttaattttaatcttctggtcacggccgttgctagagctacctgatgggcctttaccattgtagaaagtctcatgtttaccatcaccgccggcaaaagtaccacccggcttagtgatttgtaagtaacacgttggggtgccacctgagctagaatcagctagaccaaaccggccaattgtagctccgttagggtctaaaagcagcacttctacccgccccatcgcacgcccattatgggtacctgagtgcttaatgtggtggattctagtcttaactcgatagttagtcaggctgttagtcatgccagtaaaacgaacaccggggccataccagtctggttgatgactaccatattgtttaaccccattagctagcttgaccattaatacttgggtatctcggttactatcagcttcaccttgataaatgtacttgccagcggtcttcatttgagcaatcgcattggcatcattagtccattcagccatcgtatttaatacgttactgttcacaacctgcgtataaggctgtaccgccactgcttggtcttcatcgctatctggtcctagtccatattcgccaccgtttaaggtaaaaccaatgtgttttaaatcacgcttaggaatgacctgaataactggctccgttctagcggtgccatcaacagtaatcgtgtttaagccgttctttaagggtgtttcaacctgtggcagggttgcccggggatccgactggacaaaagtaatggttagtgtagcgtcccaagccccctggttaatgaactgtgggtcgctaatcgcagtaatatggccccaataagtcactttgggctcaaagccaaagactaaaggatactccttgccattatcacttggatcatcgcttagcaataagccgctcaaattatgcataatctgattgtatttatcctgactgccacgtgcgataatagttatcggaatactgattgtccgactagtgtagtccatgccattaaattgattaccatacatggccggtatgtcagtcgtttgttcggccatggctggtgcacttggcagcgttactgcccccataatagtttgcaaatcatcgcggctatttaagccagcatattcaaaatcatttttgttcaaaacagacaattatgtcaccatccttgtttaatcttaactatgtaaaaaagagccttctaaggctcttcgagacattactactaataccccatcatttgactatattgtgacgtcttcttggtgtttgacttgaccgcattaaccacgtcagagttggcaacaactgctttaacatctccttggccagtgaccaaagcatctagtaaagctataacccgctgtttgaatgcttcgtcgtaatcaatctggttattaccggtatttatcacattagtgccatcctgagctccgaacttagccattatctgttgcataatttggtaagcccgtgatcgcttagataagtccatcggaactatggcttctggcaggttgccttcaaataatttgtaaacgcccgctttgtttccgaaaccaccattctcaaatcctttaatatagcgataaacagctgacgcctgactttcacgaagcccaccggtgccgttcatagcaccgcctgattcccacgttgcaaagaatttatatgcggcttctgttggattggtcatacgtagaacagattttaacaaactactctcaccgggctcgttaagggcgtaattaatttggccagcagctgagtcccatgcatatccatgttttctaagccagcttcttaatgctgtttcacgagtgaacgtccattgtcccaacccagtaccatgatcaagtggatcaatggcggtaggggtcaagtttgattcgataacccagtttcctagaacaccggcaataccaccattatttgaagcgggatagccatgtttaaatgctctagccaattctcgtgcacgggaagcaacactaccggacagcttaatgttgccaactcctccaccgaagttgtcagctaaatcagaaatagctttcgcaaatccctttaaagcgcggtcaactagccctttgcctaaatcgtgaccgattgaaccgactcccggagttttggtcggatcaaatgtctttaaagccattgactttaaagtcttcaatgggtgagttatcttagataatgcatccattgctttatcactaacgctatcgaagatagaagtagcaccgctcttaattttctttaaaaacgatgcgatatcaatagtacctttagcatagccaggaagcgtatgccctagtccaccgttgaaaagcttagcagtatcaccagcattaagaatctgatcgccaggtttaacattgaccacttcagcaccattcatacctagaaatgacacttttccattgtctctatcaattttagcctcaacgccgccttcgccaactaaagctctagcagtgccaacaataccgccggaagcataagctcccatcgttactggagtataacctgatggataagcaccaacattgattggtttaataccaaatcctttaactaaattactaaagaaactagtaatgtttttccaaatactatggataccggaaccttgtttgtcagcagccttcatggagccgttagcttgcttaacagcatgccccaaaaccccttttgactgtgaattggcctgatcaactaccgaactgttttgatccttagcatgtttaacaacttgtgatctttgcttatctgcgtcatcagtagtgtgcttgtattgacggtccgcatgttgctcagttttattttcctgctctaaggcgttgtcaatcgtcttttgcttttgatccttagctttattaataatagctgcacgttgtttctcggcatatttagagttcccggagtattgatttttagctgcatcaactgttttactatactggctctttgcttgactgatagcctcgctagcttgtctttcagctgcttttacaaccttattgtgttgcttttcagccgcagaaacacggtctttatattcttgatctgccagtgagactgtctttttgtactctttattcgactgtgaaatagcatcatttgcttgttcacgggtgattttccctttactcttggcaagattcctcaaaatatcattctgtttattagcagctgactttatctttcccgttaaagttgtgtgtaagcgggcttcttgtgcagtagtttccgttgcacttttaatccggagtttatcaagagcggctgactttttattttcttcagccttaatagctgctttctttttagacatgtctttctgaacaataatcgagttggcaccaaaccgtcgttcgtcagatgctattttagcatcccaactagaactagtttttctctcgctagcattccatttactaataatactggctttttgctgcgcataatacttcgcaatagcattgcgatcagaagctgacattttttcaaaacgatttgtctcactatcattctttttaattgaagctaattgctttttatactccgcatcggttagcatacccgctttatgaagtacgttcacatcatttaaatcttgcttctgctttttagaataataggaactatacgccttacccagatcactcagtgagtgcttagtggactccgtcttaatcttgggagcttcaatggtcttcccttttagcgcatcactaattcttttaacaatcgtatttgcagttttagtactaccaacaccatcaccaatgcttgctcctaacatagctacagcagctgttcctgctcctggaataacacttccgagggctgcgccaatgccgcccccaataagtgttccagctgttttaccagttgctttatatttatcagacgccttaccggagctaactgctttagcgatgctactaccagcgtcccaagcagtcatggctaatccagcaccattgataatccttgtaccaattgttcctcctaacaatgaccatttactgcttttagcaattttttcagtgttttccgcttcaactgatgtagagcttaaatcagcgcctacattcccagcctttctacctttaacccttcgataaccagttccaatattttcttcactggccgtacttagttcagcattagttttaagaaccacgttttgttcttctaaagccttagtttcttgtttaatccctaaaactttttcagcccagctaacagtatcactaatttttttaaaagttgatagaactgaactagtctctttaacggctttacttgttaaccaccatgctgctccaaattttgcaatggtttctgtatgcccgccaaccatactgagtaatggctttaaaagtgcattggttattttaagcgattcgatcagtgtttcaaagcctaggccacccaagtttttgacagttttgaagaaattaacaatctccggagcatttttggcaatagagtcagaagccttggtgacacccttggccaagttatccattgcatcattcattgcttttggtgctgacttaacatcaaaggctttagcaaaagctttagtaatcgtactaattcccttttctgcagccacaccgaccttagtaaattccttgtcagtccgtttgtcagatacccattttgaaactgcgccataaattggattttgagcagttaaaattggcttttcaatgtcgccaattaaagctgggacacgcgctttgatcgtacgttccataccaaccatcgtatgtaacatgttgtcggcagctttatcgtattttccagatccaagttgattaaacgtattttcaatatctttagcagatatttttccttctttagccatctcactcaaatcagcaactgttaccttactacttttgtgagtcttttgggcatttgtttcttgttgagcagcatattgcgagttaaccttaatagcttgcttaatttctgcattagtcactttgtgcccacttgcaatttgcttgctaaaaactgtaaattgttgggcactgacaatacctttttgacgatatgtttctaggtcagataaactattatttgttccataatgcatttcttcaaacatcaaggtcatttttttgttataggcacttacggctttagcagcacctttacctgttgaagcagccgtatcacccgtcttttttaagccagattcatacttggccaattgttcacggaacatcgggaaatactggctaatttggtttaacataccagcattggcttttccccgtgacaggccgttaaccatgtcttgcgtaactgcctgtatctgttgtttatctaatccaaccgcatccgacatgttcagcatggatttggctagttcatctgattcttttttattggaatgtaaatgataaaacccttgttctaattcgttaacaacatctacggcttgaccagtcttaaccgacaagtcgttgatcgttttaaccattgcgttagatttaccaaccgtaccagttaaagtcaaacaggtggccgtcatcttttgttgctctttttcgtattccataccagcgctaatagcttcgtgaatatgtgaagtaattgattgaaaagcgctcgtaataccattggcaactaaatgagcacccagaattttgccaaataaatgattggccttatctgcgtgctcgtttactctatttagctggctaatgactgacgttaatcctgactgtggctttttgcttaattgctcatcaagctctttcatcttagtccgagtttgggcaattttagtgcctaattggttcaccctaatctgttgttctttgaactctttagaactgttaccactagcattcgcaatcttatccagtctgctttgctcagcctctagttgcttgttaagttcattataagattgatgtaacccactagccttgactttgttagcttcaaactcgtggccttcggcttttagtttggctacatatgagtctgttactttagctgatatttcggttgcatcttttaattgtaagacaccacttttttgcagatcaagtgacttctgtgctcgttcttgttgcccctctaaactggtgattgagcgtttggcagcgttgatctgattttcatatttaacgtaagcttctcggcctttttgagtggtctggtctaatccgttttgctcacttttgagacgctcaatcactaatcgttgtgcttcaatagctcggccagcatctttgactttacccgcataggccgccataacaccttcacccgaacggatttcagcaaagttagcttgcataccagattttagtaattttgcttcattctttatttctcgcaacgtgcgagtcatgccaccatcgtccatgttaattgcgaattcgtagccttgaattttctccgttgccatactttgcctcctttacaacgcaccaatttgacgtgctaattcgagtggatcttgaacacggtctttacgtgacttggcattcaacgctgtttgcatttcactaaatgagctttgataaaagtcgctaggcaatatgccttgtgaaatcaattgattagcgatgtaatcaatatcctgaataaaattatcaagttgccaaatcattctggctttggcaattttgggtcttcgtcctcttcctgatcgctactgctgcctacagatggtaattctactcccaagaattgttttaaacagtcattaaagaagtcgtattcgtcgctaaccgaaaattccatggacatgacacgcttcttttgtgaagcatttagttccaataaatcacaggtcgtttcagccacaacctttgcaagcttaggcgttaattcgaccacgcctgtaatgctgtcctcagtttcttcagtagtcttgatgaacttcttatatgcttcggccattttctcaacattttggccactatcaatcaacgtatactgcgtgcccgtcccaattttcttaccatcaaatttaactgattttgccattatttatatgcccctttgtgtatcgtttattatcatttattgtgaactcgtgcttagaatgtgcttctcagcatgtttaaaagccgcccctagcggtattgtgaatttattttaggcgaccataattatcatttattactggttggtgcagatgagtcactatcagctttactagtctgtgagcctgtgtcagttgtatctttattgaccactggtgccgttactcgcgtttttataaaacgtttgtccggggaatacagcgtcaaacatcgcttgcttatcaaatttaggatctgactcagcatataccttgtacggttggccgctgaatttatcatagttcaaggcggtaaatgtcaaattatcatcgtcacgagtttcagccgtatccgtgttcgtttgaatgttctggccagcttcgttaaaaattccacgaccaaagcagaaataaacagcagtacgtgtcactggtgaacgtgactcaataataagaccagcttcaacgggtgtatcagaatcaatgtaaccacctttaccatctgatacccggcctaatagtttttgcttgacgatgaaattaatttcatttgcgtcgattgccactgacggtgccgaaggtggattagaaacgtccacaacttcattgttgccagtgatcttagaaaccgtaccagatagcccggtaatgttagcagtcttagtacccaagttaccgtttgctttgctagtatcaatgggatataccccagcggccgccaatcccttatctgcatcaataaccgttgacccatcatcggctttaataccggtgtataacatgtttaaacctaatgttgccatttaaatggcctcctttatatagttaaatttcaaagtgttcgtaatactttctgaatctggtgttaacgtctggccggcatcgctatagcaacgaatatcattagccaatagcacttgttttaacccggcttctatggcatccatattgcccaagtaatctttaggataatagagctgtatctgaacttgcttcgttgattggaatggaattccgttgccataatcttgactacgttcaggtaatccgctgactactacaagcggctcgtcagttgaagtatcgttagttggaataaaaaagctatggatatgctccacagctagttctggtatttcattaatatttgcaacaattatgcttttaataaaagctaccggtgtcacttgcccaccttcttgtccatagcagtctttaattgttcaacaaccgccttgccaacttggccttttgcttcgcgctgagtagtctcccaaaagtgtttcccggaaacatggctgtgtttggaaccattacggtcaacgacgtcccagccatcatttcgaaaacgtgcaatgtaccctttttcacctttggctgtaaagccaacgttaactgagccattaggatgatctacagtaattaatgaatcacgtagatgcgctttttcagcatgaccatgtaccttgcgtagtttgcccacaggaatcttaggcttcataattttaatgaactgatctgctccagctgcattagctttaaccttctcttcacgtccaaagccttccgccatagtatctaaaatatgttcaaatgagtctgcatgtttaatctcattcgccacgcccgatcaccaccttatgacaagttatgaggtcaaaaccatctggtggcaaaccatcatcgtaagccacatcatcaatctggtaaacatcctgatgattgcgtcgcaattgcatgccggtagctatttttcgattatggcgcacaaaataaacggcattctgttgtgaggtgtcgccatttaacgctaacctttgctgaaacgacaatgaccattcgccagcgtacaaactgaattgagggacaaaatcagtaatgggattacccgtattagggttaacttttccaatagctacctgagtcccaaactctaatctaaaattcattcgtgcaggattaattgctttcgtcatttgtccctacctcatattgcttttgactgtacaatcctcttagttggccaatgattgagtccacgaccagattaaccggattaacagcaatagccgtaatcgatgttcgataagtccaatatgaaccagctaaggcgtaaatggccgtttcaaacaggtctttcacgccttccatttcatagaaccctagaacactattgtcgtccccaatggcctgtttaatgtagctagtggccgcagacaagtagccttttagtaactcgtcatcatcatcaccatcaattcgcaaagatgatttcaatgtttctaaatcagctgccacttaaatcacatccttacttagccgcccagattgtcactgtactgtgtatttattggcgacatagttggctaattacttcccgtcagtcgttgtagcagcgctcgccgcaaagttagccgtttgatcagcaatcttactgaacgaaccggcaacaaaggcctctgtatcagtagcttcaacatcaaaacgatcaattacacgaatcttagtttgatccttttcaaaggcgccagctccgatattagtcgttaacaatgacgcattttctcggtcaaataaagtaaccgcttgtgataagtcaccataatacaatggataaactggtgccgctgctgtcccagcattgggtaaccacttgtcagctacctccacaatccgcttaccacgaattaaataccgatcaggttgtgttggatctggttgcagtaggtaacgccccatagcatccttaacctcggaaagcacattgaaacccgacgtatttgtcattaagaacgacgtagacttaatggcaggatcaacagcagtattaatcatcgtaataatgtcatcaaacttagctaaggttggcttctttggcgcgttgttcatggcttcgatgatcttagcgttgcgggtaacgacaactttcttggcaatccattgtgataaccaagctagaatattatcagcagtgtctttgagcaacgaattagtagccgtggtaatgccagaataacgatggattgtgtatttgataatggacaaacgtgggtcatcgttgtcaccaatagtggctgtttcatcatctaaatcagctaaagctgtcacgtcagtccacttttcgtaaactcgtgacccagtttgagttgtaacagcttcccgattaacatactgctgtaatgaatcgtattggcgaaccagcgtattaattgccgtttgaatatcttgaggaatagtcaaaccaattgcatcgccagcttcgtcggtagaagaagttaccaagttcataactttcggatcacctttaatcatgccttggaagttcttaatgaacttagctttgatgtcttcttcgtcatcatcaagtctggtcttgtccttatcatccatattggcaatttcttgagccttgcgttcttcttccaattgttcatgtaaagcgtcacgccgagcaaccgcattgtcgcgatcttgtttcattgctttaaatttttcttgatcaaagctgtcatcaaggacagcagcgtttaacttgtcgttcaagtctgataccttttgcccttgggcaatccaagcatcattcattgtgttgatattagccattagttggcctccttttgatttttcccaaataaaatagccaatttgctgtttcgtaattcagcagattgactattagtagtatttttttgttcagcaggcttaggcttagccttgtctgctttgtaaattaagttaagcagtttattaactgctgacttaggtggaatgtgtgaaatagcattcaccggttgtaattgttgatcattagcaaacataatttcgtcagcgaagcctttatcaacggcatcattggctgttaaccatgtttcatttgccattagctgtagcaaatcagcttgctccatgccagttttagcttcataggcactcgcaatcgattgatcaatgccgtttaaaatgctagcttcatgttcgagatcgtcagcattaccagctggctgtgaccaggctttatggatcataatctgagcagttggtgaaatagacaccttatcaccagccatggcaaccacacttgctgcactagctgctaagccttgaatattaactgtgacattacctgtatagttctttagcatagtgtagatttcactagctgcaaaaacatcgccaccattggaagcaatatcaacttcaagtgcttcatcaccactgtcgtcgtttaaaacactagcgacactcgaaggtgatactgctggcattccaaagaactgatagaaaccggctgtttgatcatcaacaatgtcgcctttaatcatcactttctttgtcattattatcacctccttttcccgattgaattacaacttgttgtgttggtgacttttcagctgccggcatttcatctgggaagtagcccgtttgttgtaaaacccaagttgcttgattattagcaatcgtgccatctttagctagccctgatagggtggctgcaaatgagtcacccaatgggtctacagcagtccgtatattggccgtaatcttagcattaagcttgttatccagttcagctaaaattgcctgtaaatagcgattaagagcattagtgtacatgcctttaatttggtcaatgttgctttgttggtcaccctgaccgttcaaatagctatcaggaatgccgaaaactttagcaatttgcttactcgtccaatctgtttggcttaacagcttggtaacatcggctttcatttctaatggtgtatactcttccaaatcatcaagaacaactgggccgccgtttgaatgattaacctgacgaataaattctcttgaacggcttattttcattttggttgttagtaagccaccaccttttttagctgttaaaacacccggagcgctgattgatcgcgccaatgcggctaatgttaaatcgtttgatgaatttttaatttgaatctcattcgataatgcttttaacggactgttgcctgtcttgccgccatcggtactagcccagcgaatgtgaatcatgtcagactgtggtacatattgtaagacacctaattgtggctcatcgaaagtaactgtataggttaagccactgccgtcatctaataagtaggtttgcacttggctcggtcgcaaatattcccagcgcagatctaagccattaggattacgccaacgatatgcaaagcattcaccacccaataacaattgtgaatacatagactgccaaaacgtgtgcccattagcggtcgtgctaggattgtttagaattccttgcgctcgtggcatattggccattaattgtaccgtggctaagtctccagatatttggttaaccgctgaataaatatctgaatttttcaaagcatcgttagcactaacatactcatgactaccagttggcgttagaaagttaacaacgttatcatcttcaaccggtacactttgaataccaatcgaattattaatcgtcgtcggcggtttaaaaaatggcattgttaatcacctcctttttgaccagctgcaacggcttcagaaagccagccaactaagaacaaagctaccgcaattgctagggcaccctgggcctgcccaaataaaaaggctgcatacactccagcaatcatgcctagaatgaaacacagcacatcaaagtaatgccaaatggtagcaaaaagttgtttaaaaatcatcaatatcatctcctaacagcccggattctggattgttgtaccactctaacgcttccttatctgttaaccgatcaattactgaaccagatctatcttcaagtggcccgtaatccttgaaatgatacattgcttgatatattgcatcaatcaaagcatcaactacgtcaatcttgtatgttgctttaagcttgtccacttgcataccaattttgtcctcataagtttcagcattgaggagcgccttttttagaacaggatctgctaataaagaaattgaactatcggcgaatctttcctgtaggaattttgttggatctccaatttcagacgttctttgcgcaacatcaagcaatggccaatcaaaattggcatctaaagttttaacaagatcttttactcgatagtctcccatacgatcatatccaaagaacttaacctttaattggttatgttcaacaaagctaaccagccagtcatagacctgttcgatattaatcaagccttgtgggtgtgcggtgattgtgcagaatcctagcttgaccatatcacggtatttaattccatcttgtttttctttaatatcaattgatccagcttgccgccaaggaatgaatgaatgttgcatgataaaccatttttgtttatgttttctttcgtcaatatatggaaacacaaaagcaagcgccgtattatctgaaaacattgaactgtcaaacccaatatagacatcttgaccttgaatcgaataattattgataatagacttctcgacttcactgagcttcaaatatgtagccgactttaactgcatccatatatttaaatttctatttttgaaatcattaatagtgccgtcgttcaacttattatctttttcagtctgcagcccttttaccatggtttgattgtctttaatcatcaaaattggattagacttaatccacgtttcaggcttattcaactcatcaggagaatcttgttcccacactagaactagaaattcatcaccagatcgtaagtaatccttttccataatttctgtcatgcgtatttggtcgttatggaacggaaccgttggatcatcatacgctgtagaaatctgaacgaactgatggttgggtgtttgtacttggcctgatgttaccttactaaaattgtctgttgtgtaatgcttatccccagcctcatcagctacacaaaacaagaaatgataactgtcaaattggcccgattcattagacattcttagaatattgttctgagttttatttccctttacttgttcagattgaacatcaacaccgtatctatcaaagaattgattcttaaaggctgccacttcttttaatttatggccaaacatctctacatagcgccagccctttttagcttgtgctgcgaccgggccaatataagccaagtcttgattaaacttagaagccgcttcaatcatatatgcataccaaagcatgatattgaccaaataggttttcccatttgtccgggcaactgacagtgaaacacgagtaaaacgtttatggtttagttcatctctccagccgatcattaaacaaagaattgctttttgccataatagaagtggtagtggaaccccagcgttaacatctggacaaagcttagcaaaattcagtatttttctgcactcactcaagtcatagtgataaggaaaatctatgcttcctgattcagatcgctttaaatcttgtaagtgtctaaaacaggcgagtttcattttataacctgccaagatctcgccattaagcactttaaaagcatattcagtagctggatcatggtatttttttacaattaattcatagttttcacttctataagcgctgataacatctttattcttaatttcaatcttcgtcattttcatcaccattcagcaaatcagcaattgaaggttcttccttgctctgattagcaagttcagacagattttgacgcccttttggcgatagtcctagctgcatacctatagaatttagcaaggtaattgaatcttttaatgttccaactgccgggttcttcttaaatccaacaaaatcctgaccaaccactgcaccgtaattatcctgcaaagatttgaacactttagattgaatgccattttctttaatgtcttcatatgcttcacgatatatttcatactgagaacaatagttttcgactaaaaatgagtctattctatgcactttgtcagtagtttctaaaaaaggcacgatttttcgccaacagctggccgcaatagcccctaattgaactggcggatccttggatagtttcccgtcattctgctgatagaatgtttttttcattgtcaaagatcctccttcccaattagtgcctgccccccctatgttaaaattcaaaaaattgatttttttgcaagctaacggcaatgtgtgtgctctttctgggacgtgttagggggcgggggttgttttaataattattgtgactaaattacattcataaatttagaattgcttaaatcgaacgacaggcgcttataaattaatgaggactgaccagtttgattcttctgacaactgatagcctttgctttttagaacctgtctcagctttctcttttgattgggattaaagctgataagatcaacataagccttatcatcattctgtaaaacagctgtttcaatttcactcttaacatgtgcaatttgcttatcggttagttcctgttgcattgctgatttaattactttgtagtcaggaatcttgtcatacctgttcgacatggctgccactatcctttctattaccctagcatctgactaaggtgttcacgttttaactctgattgtttaatagctttgacaactgtttcagtatcaatggttgcacctgatttaccaatgaactcaaacggtgcaatagactcatcaagtacgacgacatcttcggccgtgtgaacttgctgacgccactgctttctaatagcgtcctttgtcttcatatcaacaaatttgttagcattcacgcaaataatccacagattgattgattcaatataatacgatttcaatgacttcaccccttatccattaacacaacgactgccgatacatcattgatcggcgttacgctttgcaactcgttgccttgaccagtgccatagtatgattgctcccagtccgtcttagcacgatgacaactcccacagattacagctaagttatcaacgttagctttcagtgtttcgtcaaactcaattggaacaatgtgatcaacagttttagcgggtgtgataacgccttgcactttgcagtaagcacataagtaatggtcacgctctaggacttgttgccttagatgtgaccattgtcttgtccgatagaagttgtattgctggcgcttatcctcattgcgataacgtgtaactgtgttgtacttgtgcgtgtattgcttatcatgactacgtgcccaacgttgccgactagctaagtactcagcttcatgttcatagtgctgctggcagtaatgatcaggtaaaacaaccattgcatggcagttaggatagcggcatcttctggttcttggcatgttgcttcctccgtttcttatccaaactaaaagcgccatgcttgtttgcacgacgcttcatccatttatctaagtgggcatccatctctgcttcttgtggcgtgacgtagccgtattttgtgttagtcatctttgccataaggtgcctcgttgtctttcatattcattgtaattcctcctcgtatgtatcaaaaaactcccgccaataagcgagagcagtttgaaggattactgagaatacctgagggagccaaagccacctttcagtatctatatacaataccacagcgcgcatgttcctgcatgcaatctggtggccagtttgattgcgctagttatatgcttggtaaggatttgcaccctacatgatgaccgcacttccccttgtcagcagggcgctattttttaacgtacttgccatctgacatgcgtctacctattccgccacaagcacacgttagatttatgaatagcctttgactgttgctggccttgccgtctttttttcgtgacctaaatgatttatcaaagcctcgtaaggccttgcatcactaactttcattagaacttcacggctattcaatgtgcttggtatggaatcgaaccacacacggattaaaaccgccttttttctggcagatcattaccagttacaagcacactacctgattaatcaagttagcagttccattttacgggctgtaattgccaaagtgccctatatcgccggtaggcctcgaacctacatcccattgtggcttaccaattagcccacagcgactacctaataaggaaattgaaatgacagcaatgaaaattagattgattgactatttggtactctatcaatttagcacgatttcaagcccattttttccaacttttttccaactagccaaaatcagatacatcatacaagttaagctcgcttgctactttggcaataaacttatcaactagataataagctttgctcttgctaacaaatatcatcccattagttactaggctttcaaccgagtaacgttgacgttttctaaagtacagttcgcatatcagtgtttcggtatcttcaccgcattcgtccaaacactcatcaattacatctcttcgatgttggaatgcccgaatcgtttcactgtcagccacagagatagcagcatactcagttggtgcacttttcttatattgagcacgaccaccaccaacgttttcgtcaggttcttgatatggatacataatatttagctcctcacgagcaattaggccatcaattagcggatattcacgtaaatacttctcaaccattttcttcgtcgttctttccaagccagccactcctctgtgatataattaactgtcaggttaattatcatagatgtcagtggtcgccctagtaggcggctttttgtttactctcgcgattgctaaactccacaatgtcagcaatgaagtcctggccaatttgtgcctgttgctcagttgttagcgccgcgttcatttcaaggttggcaaccatggatttcactttgattgctttagcgtattcggtgtcagtcatggttattcgcccaccacattagtgccaaacaaaaaattactaacgtaacagttgcgagtgcccaatatcccaccaattgcaacggggaagagttccaaagaaattcaaatatctgtttcatttttcttcctccacttgataattgccataaatcagtgccaacattacttgtgcttctttgaaactatatgagaaataatcatcgctccattttttgaagccgtcactgactggcaaccaatccatgacctgctcacattcttctttacaatgttcttcgtttctagcaaaaatatattctaatgctccttgaaaagtaagaccgttttccatttcttccgcaaaatactcaattctttcaacgactggtttaggaaaaatgatttttggcggaacacattttccgtctttaactgaccaaccgtaaatacttttagtcagctttgcaaagtgagtatcagtgtctttcacaatattttctatttctttgttcatttatattcctccagtagctccgggttctcgtgcacattgccaataacctcaatatcgtttggcgtcgcttctcctaaaacgttctcgccactaagcactgtttgtctgtcaatttcaaattctggagtgctaccatctctcatgtactcaacatcacttaccacattaatgattagtacacgaataatatcgccttcgtagataggcacgccgttcacatctttcaggccggtatacttctcaatgactagaccgtttgaattatcaaaatcaacagcagatactaaatcaaaagccttacccaccggcacaatctcaaataaatatttatttgccgtatacgccttatcttccttgtcccacgctctaaacttaatcatcgtcgccatctccttgattagtttcattccaagatactttgcttatggtaaggaacagtcataattgacgtgttctggcccttttctctgaaatatttcgcatcttttctagcggcttgtctattggaatagacagctgccacatcactattaatcatcaatatataagccattttcagtcctccccgaacgcccgcttacgaatgctgtatggctcatattccttggccaattgcttgctatctaatgctttagctttgtgtgcttaggcatcctcgtcctccgtaatgtagtatttgttttcgtcaatcgcacgaatacgcctatcaatccaactgttactccgttttagctcccgaggcgtcctagttttaccctgtttgcctgccatgactaatttaatggcattatactgggcacgcgtaatctccatgtaatcgcccgatacggccttaattccaggcatcttatgcaagttagctagtttgctctcaggcacgttatccatgctgccatatctcgcttctagcttatgaatggcttccagctctttcggccaattttggcttgtcataaacaatcttcctttcaaattcttgttcatattgtttatgtttattattcatacagttgggacatgggtcaaacgtgaaaccataactcccaagtggttgctgaacaactttactaccatgacataattcacatttttccacggtaatcgtcccccttgaactcgatgctattattggtgccatgtttcttcatgcggctaataagtcgatcaccatacaaactcggtagtccggtcccggttaaattactggttgtaatgactgtcttgtcctcacgttgacgccaaaactcgtccgccaaatctaacgcataatcggtttgacgttcactgccaaaatcatcaaggataacaacgtcagccaatttaatagcactcataattcggttaatttgcttagctaagttgtcatcattaaatgattgtttcttttcgactattaagtcgcgccaatcaataaatataattttccacggtgcatgatcaggtcctggtcgctgataattgctattttcaagtatcttgtaaacaacactgatagctaaatgtgttttcccgagtccaggtttgcctatcaacaggccatggacagtatgaccattaataatcctatcagctaattgctgagcaaacttaaatgctcgttgttcagccgcagtctttgtttcaaagttgctgaaccggtgattaaaaatgttgaaattgctgaaaagactgtaagtgttcagataaccaagtgcatcgtttttcttagctactgtggttaattggacgtcatttggcgtgttacgggttcctagcggctgcatatagccacaattagggcaagctcctggcatcttttcaccggtagtcttattgaggactattggtcgtaacagctccttaccacatattggacactcagcattaaaagtttctaggtgcttggccattgtcgcaagcattgccgttgcaactgttccttgtgctaccatggcgtgccacccccataatcttgtctaaccgatttaacaccagtacgattagtattagcctttttatcccttttgtaccaattgcgaatagctgccaaatagttcttgtacgtcttccccttcatactgcaatactcggaaacacgctcaatccaatcctgccaatctgaaggaaactctgatttaagctttgcaagttgttcatccgtcagtaagacattctggtactgtccgtatgcatgtcgagacggtttaatttttgtttgctcgggattattatccggttctatatacttatctttactaaccttacctaacctatccttacctaacctaacctcggtatgacaattgcctaccaagtgtccgtcatttggttgaccgttggttgacacttgactaccgaaaggtaatttactataactagcgtcttcatttagctctaattgtttaagctcactagtatatttcgtggggtgcttacgatctgatcggatgtaattatgaatatgccaatctttaatcacagtgacgccattctcaaacggaataaggtactgcttggctaacaaaattttcaaatcatcatcacttgaaccagtcatccgcataatggattttgtattacccacaaacccatcatcatcagcatgcatattcaaatgaaaatatagcagctgagctgacttaggcatatccataaacaaatcagaatccgtgatcgtattactgaacattcttctttgtgccatcttttaatcctcccttatttactagtaggcattccacccacccggtgtattagtcactgctgcatttacctatcgaaccaattcgttttagtgtttctaaatcacatttttatcttttaaagtctccaacaaaaattttccgccagccaggccttcatccgcatcttcaaattgctgttgtaatccacctaagtaactttctacttctaataacaaccagtcatattcgttaagcagtgcaatcttttcctcatcgtctaggtcgtcaaacgaaacaatttgttggcgtgcctgtactgccttgtaggcaaagtcagcagcacttgtagctgcagataactttttttctacacgattaagtttcatttcaaatgactggcattcagatagtaagtccaccatttatttcagccccctattaaacatctgcaggttcaagcaaaatgccatcgccatattattttcaattagctgtaattctggagttaattctttggatcgattgatgcaatccgtgaaataccattgaaaatgcaatcctgttgttctttgtaagataattgattatccataattagtggtctctctttctcagcacttgcaaacattcctgattagcagtaacatagatgctaacctttgaatagttttcttgctcactactcttgtattccactccagtagtgggcttttttattccttagcttgccaacaaactagttttagaataatatagatgttggcattgaataaatactccattagtccatcgttagccgatactagcgatggctttttttgcgctcgtttccattcgttaactggtaaaactgatacttttttcatgatcattcctccatttctagtgcttcttgccaatcaatgacacagccaccaccaggacacttgctaacagaaatgtcttcttgtgataacgtattgataacaccgatactaattccagacttgtcccagatgattgaatgcttgccggacaaactagcaatattcatttcacttagtaaatcatttgtttgtgccttgtcagcattggcaactagtttatttccaattccaacgaacgcatctgtgtctcttaccattacgtttcctccttaaattccaaaccagtttctaatctcacggcgcttgtaccacaatgtagctaacgcccatgtaattagtgccggcaaaatccattctggtaaaataatcatgttgtttcctcctgctatttatagctatttgtttgacgccgcccgcgttcattattctaagattgagtaaatagctcgttttagttcttctgggacaaacaacactttattattatttggtagtttgtgttcaactagtgcaatttgcggtaactttctaagctcatcaaatttggactcgctcagtcctactgaatcagcagccgttttgcgatcaaataggatatattctctgactatcttttgaactaatggtgctagcattgaaacaacttccttttcaactacgctttcgagataatcagctaatatttgattgtccatcttactcgctcctttcggtgtataattttgttagttcaattaatagaggtgaaaatttatgaagcaattcaagtgtccattttgtggtagcttaattagtgatgaacaagtggtaaccaacaaatttcataacttattcatgttgtcctctgtggacaaggctaaccacaaaattgacccaaatggaatcgttgtgaatgttatagaatgcgacgaatgccataattgttggcttcgcgatccaaacaattaaaagcacactttcaatttgtgttccttgctaccgccaagctcggaacactctttttatttcttacggtacatctttcattcttaaatccatgcaaatcaccttctaagttttaatatgtttatcttttatccttggatttgaactataattgtgtaggggtgtcaatcatgcctaaaacacatttacaattgtttacaagaaggaagttcgtaacttgtccattctgttctaaaaagatttatgctcgatccaatcatgttgtctgtccagtctgtggtaattattttgtagttagcactaataattcatatagaaattcttcagatgacactatcaaacattgacttattccaagttgatcgaggtgatacaaaataaaaattccatattttgataatccgggcggtaggttgtccgttactgttgaactaaaacacgccgcaaatgtttacttgcttgaccaagcaaacttcaatattcaacaatccggtaacccgaatttcacatattacggagggcactacacccaaacaccagtaagaatcactgtttctggaagtggccgttggtacttaatcgttaatactggtgattccggcgaaaactaccgatattcttggtctaaatagttccattattttcatagaacgacttcactttttgcactacttctgtaaagttatagaaagtgaaatcgttctttttcatcagtttaataaccttttcagtcactttattctcagcttcaacggatactaatttcttagtaagataattattttgcttcattcgtataattcctttctatgctggctactaattcaagtaaagatagctcataccaagcacgtctgccgaataattgtcttagtggctgtagatggctcccagtcgttgatgaagtccattaccatctggtagtccttcttgcgtagcattgaccgagcactcacgttagcaatcttcttgattccactgccgatatctttaaatagctcacctcgttgtttctgtgtgatatggccatagctatgtgctacttctgatacccgttgattaacacgccggttaagcgcactatattcaggattaggaataacttggttctctttgaggtctttcacatcgccctccacgctatccaggcgttggttcgtttcctcattggcttgcaatgccaatcgtgcaatctctctcggtgatgttggcaatttcacttgttcttccatagagttgaatgcttcaatgtattgaagtttaaattgaagtgccttatctcccgtaaatcccattgctagcaaagtgaaaccatcgcgattcatgtacacttgacgataatatttaccacgatttacataatctgactcagcgaacattgatttcgtggctgaattttcagccgcgagattatcaatattttggagcacgtttttgtgttcctttccgaatgtttctgccacttgcaagctactggtaacggcttgctggttcttcataattactaaatcattcatgtggatcattcctttcagttgtataatcaggtattccattaaattgaggtgaaaaatatgagcttgcttcctgacaaatgcccgttttgtggttccagtgaacttagcaatgtaagacgtccagaagcgaaaggtgcgttttttattccaacaacatctgattacttagaagattctgatttaagtgaaccgtatcaggtttctgttgagcaccccagtaaaaaaggaattgccttgcaattagtcgtatgtgctaactgcaaaatggcttggatgtcatttgctggattagatagtatgtctaattctgaacagtcttttgtagattgaatgcctggtggctatacttggcattctatttttttgtttcttcaatagctttttcaatttggtaatcacctaaatcgatatttatttccaatttgcgatctattctgctttttatgacttcccaaatccgaacacttacctgctctgatatcaataacctttctactttttcactgatatcattaagcgcatcacggttaacaaaattagcactttctaatattccgtcgccaaattttttaatagactcatcattcatgtggatcattcctttctagctacgttctcttttgggaacgcttattgtaaaaaaaattcctagttcatcgttagagaatcctaatacacttgctatcttcgcaagttcatcagctcccaagctaacttttccagtttctcgtttggaatatgttgctctacttttccaacccaacatctttgccatatattcttgcgaatatcccttagcaactctttcggccttaactcgtctcaaatctactgacattttttgccatctccctccgttctcgtttgggaacgattaaagaatatcgcaaccgttcccaattgtcaacaaaatgtctcaaaaaaattcataaagattatttgctatattgattgtttccatttgggaacggtgctataatgtgtacactaattaaggaggggattatgttgagaacgaataatgaaatagtcgacacattagtaaaattaaaggatgagcaaaatttaacactcagcgaactggctagacgtgtaaacatggctaaatcagcattgtcaagatatttcaataaaactagagagtttccgctaaataatgtggacgttttcgctaaagcattacacactactcctgagtacattcttgggtttgaaaaagatgaagtttccccattaactaacagtgataaaaaaataataaggattaacaaaatgttaacgcctgatcgccagcaaaatgtttacgactatgctgacaatcagttgaaagaacaaaatggtaaagttgttaacttgccactcgttggtaagtcggccgccaaccctactgagctgacctatggtgatgtagaaattgaacatgacgacttcactgacgtaccacacggggcagatacagccatccgtattcaaggtgattcaatggaacctctgatccgcgatggccaaattattttctatcatcaacaagaagaagttgaaaatggtgaaattgctatcgttgaaattgatggtgacggtgttacttgtaagcaaatctactacgactacacttctgatgaagtcattttacgatcaattaacaaaaaatacgaaccgcgtcatgttaaagatgaccaggtacgtattataggcagagttatattataggagcttattgctcctatgcttatgcgttaaaaagaacacacgttctacatatttagcggtattatacttacataagacaaggtgccattaaaaaataggcaaagtggagggaaaatgaagaccatcgatgtgaaattaattttaaatcgccctgtacgcttgacgtacctagattacacctattgggaatacactatttctgaaagcctattcgatcctggaacgtatggtgtccatctttctttgggcaataatattgaaaaacataaggatcgtcacattgaagtgtactttccacggcatagcatggtatcagaagaatttgagattaatggggataaatataaactaagactgattaactcttgaacttagcagttattaccagtaacacaatacagaccagatacggatgtcggtaaaagctgaaatttttaggggtgttttaattgaaaaaaggattcctactttttgtagggggattatctttgttcgtgttagcttcttgtggaaacaattcaaagtcactaaaagctaaaactgcaaatatcacaaaaagctcagtcggtagcgggatagttaatcagcacgattggaaattatcaggaacgactgacgctcctgatggatctaaagtaatcgtatatagtaatgattcaaatactaatattgctacgtcccaaaatgaaaactgggcgaaagtaaaaaatggcaaattcactgcgtatgtagaccctattacagttatatctgatggttcaaacaataattacactacctcaaaaaaatacacaattcacacagctgctttatctaactattcaaagaaaaagactgtttctctttctaaaagggcttccaagttagttaagaagtcggctaagacttacacaatcacgttatcttcagctcaggccgcttattacaatagtctaaatgatgatagtgattcaagtaaaaaaagttctgatagcaccagttctaatagcagtgacagtagttcggatactagtgattcatacaatgcaactgagggcgaaaataacgcagaaaaatacacttatggcgattttgccaagtctgatgattggattggaaaatcatatcatatttcaaaggctgaagtgcttcaagctgacgaaaaagacggtcaaacagttcttctagtatacacggatgatgatccagaccacacgtttatggttgcctatgatggtaaaacaccagcagtcgaagacgattatgtggacattcaaggtgttttttcaaagagacaatcatatgataccaaaattggtggaagtaacactgtgccgtcactagttgctagtaaaataaccgttactggtaaagattcagactagctatggaattgtatgtaggaacgtacagtgaacacgtgttcgatttcaatgttgtaattggtatcatttgctttatagtgttagtcgtcatgttagtttactggattcacaagcgaaagtagcaccctcgcccactaccagcctagcgggcaacatgcgagcgtagttcaacggtagaacggttgctttatttttccctcgtttaggtaccccaaaactactatgcagatgcaggtccgactcctgccgctcgcattgacataaaaaatacattctccctcaccacgaaagagaatgcacctcaaggggcatgtacgaaacatgcttgaaattattatagatcttaaaatcgtatttgcaaatttttttgtgagcgtagttcaacggtagaacaatgttccaagtcttgaagcccattctttcttggactactatgcaggttcgactcctgccgctcgcttatatcgtctctcccccaaaatagaaacgaggtaatgaatatggggaaaatatatacagacgtttataatatcaagcacgacaattgtaaaattgtcaatactctacattcttttcaacgtatttttattatcgaagatgctcacggctctaggtttacttgtttaaaggatgacccccccatgctgaataaatcaaacactcattggaaacatgctagtcccagagacgcgcccgaagattatgctgtaccttacaacaagcgaaattaatttttacatctaaaatagtgagacatcatataacaagttggtgtccccttatgcgagcgtagttcaatggtagaacactatgtcccttctctctcactaatactattatacaggttcgactcctgtcgctcgcattgtacgttaatagcaaataattgtggaggcacctatgaatattgatatcacaaaactattagattggggattgatagtactatctctttacttagttgtagacacacttctgcaaataaatcataacaatgcctatggcatgtttataatagctatcaaattaatagttgccatcattgtaggattatttggtatgtacacaactttttacaacatctattgaaacctttgctaacatgcgagcatagttcaacggtagaacaattatttacacgtttctcacagatctcccatcctatatttatgcaggtccgactcctgctactcgcgtaaaaaagaaagaaggcatacttatgaacaaggatatttcaaggtacgaactaatagaaaacattactagtgacttaacagcctttgtaaagtcagacgccattcttcatctatcaaaggatagctattccaaagatgaatataatcgtatgttagatgggcttaaacatgatttaattatgcgtctagaacaaaagtagctaattgtctacctaaaagatgcaatgtttgagttatgtgaccaacgctttgtctcagttttacttctatattcatgtctggctcatatacttgcactattgattatccaaatggaggccgaattatggaaaatgttattcaaatagaattgactttgaataaagcaattaggaaaacttatccagaccgtagctattgggaatatattatttacgaagatccattacaagcagattgttacagaattcatttatcatttcacagtatgaatggaaacaattatgttagtcactatgaagttctttttaacaagagatccacattatctgagttatttcaaattgatggtaattcttttagattaaagttcaagaaaaactaaacttttcattcataattgtcagatagacactggcaatatgtgagcgtagtttaagggaaaacggcaacggtttatttacacacagaattacctccaagattgctatgcaggtccaattcctgccgctcacgttgaccaaatactgatgtcattaaaagctgaatgattttgaggtaattgaaatggcatattttgatcctgacgaaatacttcaaacaaaggaagaagctttagattatatggaagcacatggcattatgacagatgccactttcccaaagctgaatgatacagaaaacactgataaaaacatggctcccgtttacaaatatcttagagaaaatggtatgtatatatttcacactggtttctatgatagaatatttaattttggtgcaatatattttatgtttgatgcaaatcgctttgattatcaaactgcaccagctgaagttaagaagattttgagtatttggtcaaattctcaatctaagtaagcaagaaagcacatccgctcccgccaagaagttggatgtgctagtgaaagtaaatacacatagaagggatacagctatacccttttatattaccatcataacgaaagaaggtgatacctgcaagtagtccttaattaatgacgccgcccgcgttttaacttaaggagaaatcacaatgaaattagttaaaattaaaacttataacaatgttttttcatacaaaacgggttcacaaacactgtatacctatcgttttcgctactatgatttatatggacgtagacatgaaaaacaagctcgtggctttaccagtgcattagcagcacataaagccgaattaaagatggaactgaaggcatctgataatgaaattatgcaaatagttgattctactattacagtaaagaagtggttaacacgatattacgagatgactaacgctaaatggaaaaagtcatatcgaattagctatcaggaaaatatgagtaatcacgtcattccgttaattgggcatttccgcctaaaccaattgaccagaatgcaatatgattataacttagttcaaccactatcaaaaaaattatcacaatcaactattgcaaatattcatcgacaatttatggcagccgtcaatgcagctgtagatgaaagtattataccacggaactttctagacaatttcaggtttaaacgtaatcatggacaagcgttaaccagacacgacctctcagtttttaacgagctattaaatagcgaagatgccgattaccaaacattgtttttaacgttggaatacactggcatgcgtaagggagaagccttagccttaacttggacggatatagacttcactaagaaatgcattgctattacaaagactcgaggccaatatgctactaatagtccgaaaacagtggctggaaaccgcgttgtagcaatcggaaattttctgaccggacaactgaaaaagtatcgtttatttcaaaaaaagaagtcattgaaaacgggaaatacttttaaatctgatcaacttattttcacatccagattgaacaagcccattaatccatccactgtaaattaccattttcgaagtttgattaaggctgcaggaattcctaaacataaatacgtcgttcattctttacgccatacgcacgcaactatgctactagatgctaaagtaaatcctgtcgaaatagccaaaagattagggcactctgattcaactgttacgttagcggtatattctcatgcagttgctggtcgtcaggaacaaatcgctaagcaattcgacgatatcattagccaatagaattcttgtgctgggggaactactgggggaacgcaattttccaaaaatcagtaaaccctttggtatcagttcatctagcacgttttgagcaaaaaaaccaccatgttccccgatacggtggtttttttgtttttctcgtccgctctattcgcacctaccgactactttaatacgtcatagtaatcatatttgttgtactttttacattattaaaccaaaatataactaatgattaaccatgctttttagttattcatctgttaagggggagatttactgatgaagcaagtatcgattattggcgctggtattggtggcttaaccgctgcagtacggcttcaaaaattaggttataatgttacgatttatgagcaaaacgcgcaaccgggtggcaaaatgaaccagattgttagccaaggatttacatttgacgtggggccgacgatcgtcatgatgaaagacatctacgaagaagtctttcgcttttgcggggtcgatccgcacaactatttaccattcgaagaagttcaacctttaatgcaccttgtctttggtgatcaatctagtctagatttgtcacgcgatctcccaacattaattgccgagattaaccgcattgcgcctgatgacgtcaatggtatgttaaattttttagcggatatttatcaccggtataccatcgcgaagcctaattttttagaacgatcatttcgtaactggcgtgacttttataacctacccgctctgtatgcaggactacagttacgcacctttaacaatgcctacaaaaacattgcaaaatttatcaagaatgaaaatctacgtaattcattagcctttcagacactgtatattgggatttctccctaccagggcccgtcgctatacaacattattccgatgattgagctcttctacggggtctattttttaaagggtggtatgtacacagttgtcaatagtctcgttaagttattcaaagaacagggtggtacgttaaagcttgccacaccagttcaagaaattatcatcaaagataaagttgctgttggcattcgtgtcaataatcatccgatccacagtgactatgtcctatgtaatgctgattttccaaccgccatgacgacactgattccaaatgagcaaaatcgtggtcagtacacagatcaaaaaattgccaaaatggattattcatgctcatgtctcgtcttgtatttaggactagacaaaaaatacccaaccgaagcattacacacgatccactttgcacaagatttcagcaaaaacgtcgccgatctatttgacaacggcaagttaccagaagatccctcgtattatgtctatgttccatcaaagatggatccaagtttagctcccgaaaacagtgaggcactctatgttttagtaccagttcctgagctctcaaagtttaatgactggtcaccaacaacactgaagaactatcgtcaactaatcattaacaaactaagacaaacggctaccttcagcgatattgaacagcatatcgttgtcgaaaagcagtttacaccggttgacttcaaagaacagtttggcgcctataacggagccactttcggcttacgaccgacgttaaaacaaagtaattattatcgtccccataacaagttcgactatgccgaccatctttatttttgtggtagtagcacccaccctggggccggtgttcccattgttatgcaaagtgctaaattagccgttgaggagttgattaaagatgaccaaactaatgcctaaattcgaacaacatcgcactgactttgcgtactgtcaaacaattactaaaaggtcttctagcgcattctacaccgccttctcgcaattaccactagaacgcgcttggagtatttacgccgtttatgctttttgtcgaacagccgacgacctcgttgatgttgaccatgatattgatggtctaatggcattgcgccaatcattgaccacctttgccaatggtcatgtcccagaccacccaatgtggcgcgcactggccgtcgtttttgagacttatgatatgaatcttgacgtctttttcgatatgctcactggtcaagaacaagacgcgacttttaaacaacctcaaactcagcaagcacttgaagactattgctattacgtcgccggatcggttggtctgatgattttgccaatgctagcaactaacccgcaatcacttgtcaaaccagccgtagaattaggcagcgccatgcaactcaccaatattttaagagatgttggtgaagactaccaacgtggccgaatctacctgccatcaaaactattggcacactatcagctcaatccaactgacttgcatggccccatcccatctgccaattttattcggctttgggaacatgaagcacagattgccatgaacaagtacgaggctgcattaaccatgatgccacaaattgatcccgtcgcccggccatcgctattagccgccactttgctttatcgtgaattattgctaatcgcacgtgaacaacactacccaattttaagtcagcgcgtctttttgacagatgaacgtaaaacgcaggtccttaatcaagttagcactaaagtgcatgaactagcccttaaggaggcttaatgcgacttgaatcggtatcatacttggcacgacgaaatctgtccataccggaatattgaccacccacaaataatttttagttttttcaccagtcaagtaagcgatttagttaccttttaacaatcaaactactatactaaacatatagtgactggacatctccttcagccacttgaacctttttcatttactcctccaaagttaatgaaaaacaggctcgctggggatgccacctagcgaccaatgcaatttataggtcatcgcccgccgcgatggccttttatattactagaataatatagttacatctcacttctaatcggcgtatcatattattgagagattagaggagtgatatttaatgaaaaaaacacgcgccgtagccggaattagtgctcctgtggcaattttttcggccgccctattcgcgagtgagaagctctacgattttgctttcaagcgtgttgattacgtgcccgaaacttcggcagataaacaaaaatacgccgatgcctactacgcttatgtcgattggctacaccgacagcccgttcagcagtggcaactgaacgctaatgacgaggccaatcaccttgtcgcacagtacgttcctgctaaaacaaccagcaaccgaaccgttattgtttcccatggctacaaaggtgatggtgaaacgatggcaaattacgcttatatgttccatcaaatgggctataacgtcctcttgcccgacgatcgcggccatgggcaaagtgccggcaagtacattagctttgggtggcaggatcgccgcgactatttaggctggatcgataaagtcgtccgtatcaatggtcgtcacacggatatcatcctttttggtgtcagcatgggtggtgcgaccgttgaaatgatgagcggcgaagaccttccatcacaagttaaggccatcattgccgattgtggttattcgagtatcgaggaagaactcgcttacttattaaagcgacagtttcacttaccaaagtatccgtttgtgcccatcgttagttttattaaccgccaccgtatgggctattatttaagcgacgtcagttctgtcgaacagctcaaacataaccatctaccgatcttctttattcacggtgacaaggatgtctacgtcccaagttggatgctcaaagaaaattatcaggccgctaagggccccaagcagatgtggcaggttcccaacgccactcacgccgagagtttttggatcgatcctgccgagtatcaacgacatgttacagcctttttaaatcactatgttcctgataaataaaattcagtcgaaaaaccgtatgcgctattcactacgcatacggtttttttgaccgcttaagttttttatgactggctaatgattcgggctaagcggtccgccatccgttccagattggctggtccctgcgccatggcttgatctaaggtcatgacttgatcgacaatcggtaaaacggccgtgaccccctgtttggcaaatgtttcatttgcacctttctgccgaccaactaataaatagcaaggcttgccggccgcttgggctaactgactgagctgaattggtaccttgcccataaaactctgatcgtcgacttggccttcaccagagataactagattcgcttgggccactttcgttttaaaattgctcatttcagctaacaattgaaaaccagagcaaacgcgggcgtgtaaaaagtaacgtaatgcaaacccaataccaccggcagccccatcgccttcgtgggcactcaccgcaccagctgcgaccgtcatatagtgagctaaagcggcatcgtgaacctgaatttgagcaaccggtaatcctttttgtgggccaaaaatcttagctgcgccgttcggtcccgttagcggattcgtcacgtccgctgcactaatgaacgagacttcagctaattgtggcaacacatgtcgatcgtcaatcttagtgacccgacttaaatcagcgccagtcatggataactcttgaccatcggcagcccaaaaacgataaccgagcgcacgtaggattccggcaccaccgtcgaccgttccgctaccacctaagcccagaataatctgacgggcgccacgctcaatcgcatctttaatcagtagcccggtcccataggtattcgttgctaacggcgtcaaggtcgtcgtgacaaactggattccggatgcagccgcaacctcaatcactgccattttttcagtggcaaagtagccatacgttgcagtcactggccgttgcgccagatccaccgttgatgccgtaatagcttgtccaccagcatggttagccagccacgccgccaccgttccttcaccaccatcggcaatcgcaacttgagtagcggtgattccgtgagccgcaaatcgtttagccactattcggttggcctgaatgctcgtgatggaatttttaaatgaatcaattgcgatcaaagcgtgcatattaacgtctccctattgacataattacttttagtataatcattacagcgggcgcgagcaattcatatcagttgtcaggtttcttaaaactcgttaagcttaagttaccaaaattttaatggaggctgataaatcatgacaaacaaatacgattacgatgtgttatacattggtgcgggtcacgccacgtttgatggcgccgcaccactcgccaagactggtgttcgcgtcggtgtgattgagagtggtctgattgggggcacctgccctaatcgtggttgtaacgccaaaatcactcttgatgaacctgtcaaattaacgcgggaagcagcacgcctcaatgatattttgagcagtgcaccaaccattaattggacggccaacgtggcccataaacaagagattattgatcccttaccagcaggcctgacagctcgtttggaagatggtggcgcaacgatcattcatggtcatgccacgttcaaggacgctcacaccgttgtcgttgatgatcagcaaaccattaccgctgaaaaaatcgttattgcgactggtttaaagccccatcgtttagatattccggggaccaagctcgcccacgatagtagtgattttatgaaccttaaacggttaccacaaagtatcgtcatcattggcgcaggctatattggtatggaatttgccaccatcgctaacgcggccggtgcccaagtgacagtcatgttacatggcgaccaggccctccgtgatttttaccaaccattcgttacacaagtggttgacgacttaaccgaacgtggggtaaccttcatcaaaaatgccaacgtgcaagcatttaccaaacaggatgaccagttccaagttagttatggcgaccaccagcaattaacgaccgactggatcctagatgcgactggtcgaattccaaacttagatggcttaggcttagaccggattggcgtcaaatatgaccgccacggcgtttatgtcaacgaccacttacaaaccaacgttcctaacatctatgcagccggtgatgtccttgccaatgacttgccaaaggtcacacctgcagcctactttgagtccaaatacttgatgcgtttgttctctggtcaaaccagtgctcccattgactatccggtaattccatcggtcgtctttacttcaccacgaattgcgcaagctggcatgaaaataccggccgctgaaaaagccggcttaaccgttagtgataatgatttagcagattactggtattatcaagtctccaaggaaccgattgccgctagtaaacaggtccatgaccaagacggccatctcgttggcgtgactgaaatcagtgatcaagctgaagatgccgtcaacgcactactgccagctatcgaatatcaattagaccgtgaacaaatcgaccgtttgatcggtattttcccaaccatcggctacgcagcttggcaccgggcttaaaacagaaaacactgctgcgaccgccgcttgattaatcccttattaataaccagagccgccaatgaccccccactcattggcggctctggttatgttcgttccattactttagaaaccaactcgggcctgcacatcaagcatactgacctataattgcgcctatctcaacgattgaaaggttggtcctaacaatggatgtggatgctcaaaaattatttaccttagtagatgctgcttataatcagccgattaccaatcaaccatccgattcctaccgccaagcgctactggcagctgcaatcgacctgaataacaacgtttcgccacagcaagtaaccatccagctatatcaagcctattatcgtaactatatggtcccaatgactctaccacgccagcatcgtgacctctaccaatacgttcacacccaattacagcgcctcacgcgcaaagaacagcgtcatatggcacttgggtatggtctgattgcgacgcacctaacatttggtcccttgaactgaaatcaaggtacttacacgcattgcgctagttatcgtttagtatgaagcatgattaaaccgtgccattatcaagctcaaaaatagccagtaatcgtccccagcctcggaggtcgaaataggacgcgcatcggctgacgaataaacagcccatctttttaacacgttttaatcataataaaagcctcagcgattaccatcgctggggcttcatcgtttttaaattaatcgtctaatcccaatcgtttgaaaatatcatcaacgtggcgaagatggtaatgatagtcaaacgcatcatcaatcgcagcctggtccaaatgttcacgaatctcggcgttaccttcaacaagtggcttgaattgtaactgttcatcccatgacttagccgtcagtggttgaacgaggtcataagcactttcacgagacatccccgtatcaatcaacttgagcaagacacgttgactgtagatcaacccgtaagtcgcatccatgttttgcttcatccgttctgggaacaccgtcagcgtcttaataatcttattgattcgagttaagatataatccactaaaatcgtggtatctggtaagatgatccgctccgcagaagagtgggaaatatcccgttcatgccacaacggcacatcttcataggcggtcatcatgtggccgcgaataacccgtgccaaccccgtcacgttctcagaaccgatgggattacgcttgtgaggcattgctgatgagcctttctgacctttattaaagaattcttcaacttcatgagtttcagatttttgcaaaccacgaatttcggttgcaaacacttcaacgcttgttgcaatcaaggccaaactagcaatgtattcggcatgtaagtcccgtggtaaaacttgcgtcgaaatttcttgtgcgcgcaatccaagttgtttgcagacaaattcttcaacaaatggtggaatgttcgcaaaagtcccaacggccccactgattttacccgcttcaacgcctgcggccgcgtgttcaaaacgctcgatatcccgattaatttcagaataccaccgggcaatcttcaatccaaatgtggttggttcagcgtggacgccgtgtgtccgccccatttcaaccgtatatttatattttttcgcttgttgtgctagtgtcgcccgtaaatcttgtaagtcttggcgaataatcgcgttagcctgcttcaaccggtaaccttgcgccgtgtcaacaacgtcagtactggtcagcccatagtgaacccacttacgttctgcacccaacgactcggaaacatcgcgcgtaaaagcaaccacatcatgatgcgttacggcttcaatctccgcgatccggtcaacatcaaacttggcattctctcgaattttagcaacatcacttgctggaatcttccctaattcagcccaggcctcgtcggcagcaatctctacctccaaccatgcttggtactgattttctaacgaccatactttgcccatcgcgggacgcgtataacgatcaatcattgctaatcctcatttctttttaggtattcactaacaaaacacgaacattattatagcatacccctcgagtaattaatagagacgaacaatgaaaaaatactgttatttttcacttcgtttccatattaaggacttgttttcgaactaattcgccttaattatgaacgattatttgtgctcaaaacaagaacattcggtttttaggttgcgttttgacgttaaagttgctatactctttcctgttggagtggtgaacgtttaactactctttaggattaattattcataattaaactatttaatgaggtggaagaatatggcatcagtcgtagtagtaggtagccagtggggcgatgaaggtaaaggaaagatcacggactttttgagtcaggaagcagatgtggtatcacgttaccaaggcggcgataacgccggccacaccatcgtatttaatgggcaaactttcaaattacggctgattccatcagggattttcttccatgataagttagctgtcattgggaacggcgtggtcttaaatcccaagtcattagttgaagaattacaatacttgcgggacaagggcgttaatcctgacaaccttagaatctctaaccgtgcacacgtcatcttgccttaccacatcacattagatggcgctcaagaaaaagctaaagccggtggcaagattgggacgactaataagggaatcggcccagcctacatggataaggctgaacgaattgggattcgcgtagccgacctgcttgataaggacacctttgcggcgttactcaagcgcaacttagctgaaaagaaccaaattattaccaagctttatgacttagaaccactgaaatttgaagatatttttgatgactattacgcttatggtcaaactttgaaaccattcgtcaccgatacttccgttgtcattaatgatgcgttagataacggtcaacgcgtcctatttgaaggtgctcagggagtcatgctggatattgaccaagggacttacccttacgttacttcatctaacccagttgccggtggtgttactattgggagcggtgttggcccatctaaaatcgataactgtgttggggtcttaaaagcctacacttcccgcgtcggtgacggcccattcccaactgaactctttgacgaagtcggtgatttcattcgtgaaacggcccatgaatatgggaccgttactaaacgtcctcggcggattggttggttcgatagcgttgtattacggcatgctaaacgagtttctgggtttactcatcttagtttgaactgcttagacgtcttgacgggcttaaagaccatcaaggtatgtaccgcttatgacttaaacggcgaaaccatctatcactaccctgctagtctgaaggaattagaagcttgcaaacctatctatgaagaacttcctggctgggacgaagacattactggcgttaaaacctttgaggaactgccaactaatgcacagaactacttgcgtaaattagaagaactcgtcggcgttaaaattgccaccttctctgttggtcccgatcgcgaacaaactaacgttatcgatcacaacatttggggctaattgaacgtgacaccgtgaattaacttaaaggagttttgcatcatgggcatggagatttttgattacgaagatattcaactaattccgaacaagtgtgtcattaatagtcgttcggaagccgatacgaccgtagaattgggtggccgtcgttttaagattccagtgatgcctgccaatatggcaaccgtcatcaacgacgagattgccaagtggctcgccactaacgactacttctacattatgcaccgcttcgcccccgagacccgccgtacttttattgaaacgatgcatgccgcgcaactgtacgcatctatttcggtcggtgttaagtccagcgagtatgactttatcgacgacctggctactaatcaaatcgtgccagaatatatcacgattgatatcgcacatggtcatgctgacagtgtcattgcgatgatcaagcacatcaaagacgtccttccggatagttttgtaattgccggaaatgtggccacaccagccgccgttcgcgaccttgaaaatgctggtgccgatgcaactaaggttggcgttggcccgggtaaggcctgcattactaaagtcaaaacgggctttggtactggcggctggcaattagctgctgtccggtggtgtgctaaggccgctcgcaaaccaatcatcgcagacggtggtgtccggaccaatggtgacatcgccaagtcgattcggttcggcgctacgatggtcatgattggctcaatgttggccggacaccaagaatcacccggcaacattttaaaaatcgatggtaagacttataagcaatactacggttccgccagtgaaactcaaaaaggcgaacataaaaacgttgagggtaaacaaatgctggttccttaccggggccgcttagttgacaccttaaacgagatgcaagaagacttacaatcatccatctcatatgccggtggccgggatttaaaggccattactaagtgcgactatgtggtcgttaaaaattcgatttacaacggggactaataaaagaagtattcgaatggcagacggtgaggtacccaacttttgatgaattggtcgttgcttttcataaacggtaattttgtcaatcaactgtcagactaaaaataatattgagatggctcactaatcctgaatcggtgtagtaggatttaatctcttgacagagtgcttaatgcacctagcgctttgtttaaacttccagcatcaaaatagtcagcgactaattgtaccaaattaggtggtcgttcatcagccattcgagcggtttcccgaccgtaggggctgggtgacaatgctcagtagccaaattattcttagtcggaagtgggttgcttccggcttagaataagactcgtatttgagatgacgcgggttatgcgttagctcaaatcgacgtcggcttacgttccagcaattgtcacccagccccggaggtcgacataggacgcgcaccggctgacgaacaggaatccacctaatcggcacggtttaatcataattagtcctgattggtgttttggagcggacactattttttaaatgttcaatcggaatataaattaatttatatgggctagcaggattgagggactaacggtatacttattgaagcataaataccaaccaaaaaggatagtgaagcagggatgaaatcggggaagcaccgggtatcattattgatactgttatgtttgatggtggtcggtttagctggctgccataacaaggcgtattcgcagtcaatcgagaaggggttaaatgcggttgctgagaataaataccaaaaagcgctgacgtattttgataacgcgctagcgcagaagcccaaggatgaaaaggcacaggcgtaccgggatcaaacgcaggcctacttgacgaccacatcggagttgaaggccggaaaagttaaaacggcgctgacgacggttgataagggtgtcaagattacgaacggggcaacaagtttgacgaataagctgaaacagttgaaagtcaccgtaaccagtgattatcaggaatatcagcaattgtcagatgatgttaaagcacagttaaaggtgaagaacggcaactattcagcggacgtgctcaaacgttgcgcagccatcaactgggataaaaagccatatttgaaaccgttgaaggctaaggtaaaacagttattgactgcggcaaaaaaggccaagacgaatatgaaagttagtgcggctgaagcgaaacgagcagcggcgttacgtcggaagattgctgccgctaaaaacaagtggaacatggccgcattagacgatgtgcccgattggttcattttggcactttttgccgacgatagtgatgtggatgatgctgctgaagaattagatgacgaatatgccgatcaggccgacgataatgacgattattcggattgggatgagcaaacgactgattcgaatgatgacacgaacgacaccgacgcggattcggctgatgacgattggagtgatcaagatacggattcgaatgacgataccgacgatgattccgataccaatagcgatgctgacagcgattcggattactcagaagatgatgacgatgaagattcgaatcgtgatgacgccgatgacagcgaaacccaatccgatgacgattacgatgatgatactgatagtgagtctgatgacgacgattatgatactgatgatcaatatgacgatgatgatgactacgatgacgccgagagcctactcaacccggcacctgttcaaccgtcagtggccgaccggctgtttgcgtcggttagttgttagtcgttcagcggtaaaatcaccaaagatcgtctgacagttttaataatgcagttatgtgcgatataaaaacaaacgtccacgttgatttagtcaacgcggacgtttgttttcttacgtggagtttgttgccgaacatgtctgagtatcagttgctcatgggcaagtctttgtcttagtgctaattaaggttgatgtttaaagcgagcgtaaatcgagctaattgttgaaaatccgatgactattaagaccatgatttgtaatacgccagtgggttgctgaatttgcctgacgataatgtaagtcagaatagccaagttgatcagccaaccaaatcgtcttatttgcttaattataaaatttttagggcctgttttactaagcatataaagtaaaagggcgatgatgatccaaaacaatcctgatgttgagtgatagtacacgtaatcattcctttagacgtctgactttctaatgacatcgtaacaatcaacttggtacgtgataatcgtatcatttgctcgaaagcatcaaaatcatgttttagtaaagatagtgtacattttcagaaaagaaacgtgaattttttgtaaaccaccggcataattaaccggcgcatcgattttgaataagtgtggtcttgacgctggggcgccggcgctagttttggcaagacgttagtgaaagggggggacaagccatgatgatctttagacaacaaagaccccggcatgccggggtcttgtcagctatttttaattgttagttcaagttatttgctagctttaacggttttaagcatgctctgaatggcattggcttgatattgagcagccgctgctttttgaacttttgcgagttgcgctttgctcattgtcggcttcttgaccattgcggccttggcctgattagtcacgtagactttagcacgcgcttttaatgtcgcttgctgttgcttcatcaatttactgaattgtttagcttgggttgtgctaagtacgacccagttcttattgatatagaagtagttggttcgcttgatcaactgtttgtcattgttggctaagccaaaccagaacttcatggcgttactcttataagtccaccgtgtcgtcttagtaactaacttaggtgtcgcggtcgtcgtcttaacttggttagcagtcttgacgctggctgtcgtatggctaacttttttctgattagtggtctttttataaatatagacccggtgcttgtcagcggtacccacactttgatagagcaataaatcaagttgcttgctactaccagcagactttaatgattgcgtggtggtcgtcgttgttttgaccatcccgtaatgttgaccatcattcttggagacgaagacgatcgaggtcactaagagtgccgcaaagataacggataggctgattcgtaacgtgttttggtgaacgtagataaatgataagaagagcgcgattgcgctaacaacgagtagtacgagaatcattagtcgttcacctccttagtgttcattactggcttaacggaatgctgcttgcctttcatgaagaacgcgacgacgagcccgacaactgagaagcctacggcaacccagaaagccgcgtggtaaccatttaaggttgcgttgaaatagctgttctgataaccaagtggattgctcttaatcaagctatgagctggttttgtggcgtccgtaacgtttgataagacggaagtcaagatggcagtcccaatggaactagcgatttgacgcgtcgtgttgttaacggcagtcccatgacccattagttcaacgggaagggcgttcatcccagcggtagttgccggcatcatgaccatggcaatcccaaacatccgaacggcatagagaaccacgatgtaaaccgttgcggtattacgagtaatgaaggcaaatggaatggtcccgattgtcagtaaaaacatccctaaaattgccaagcgtttggcaccaaaacggtcaaaggcccggccggtaattggactcataacccccatcattagggcaccagctaatagtgatagcccagattcaaaggcggagaaaccatgaataatttgcaggtaaagtggaataaccatttcggcccctaccatggccatgttagcaactgagctcaaaatagctgcaattgtgaactcggcatgcttgaagacccgtaattggaggaatggattttccatcgtcaattgacgccaaataaaaccaatgatgaagataacaccaataattaaagttgagagaaccacggttgacgtccagccattgtcaccaacggatgaaaagccgtatagtaagctcccaaaaccaatggtagaaagtaccaaggatgcaaagtctaattttggcttagacgtttccaagacgttggccatgaagaagaagccagcgattagaacgattgcgacgattggaacgatcaaaccaaataaatcacgccatgataagttgtcgataacccacccagataaggttggaccgatggctggggccaaaccgataacaattccggcagtccccatggcagccccacgcttatcagcagggaagatagatagcataatcgtttgaagtaatggcatggtgaccccgaccccaacggcttggatcaaacgcccagccaataagaagccaaagtttggtgctgtccaacagataatagtacccacttcgaaaatggccattgcggaaagatataaccatttagtggaaatccgtgaacttaaccacgcactaacgggaatcataatcccgttgactaacataaacccggttgttaaccattgcacggtcgacgttgtgatgtcgaaatctttcatcaacgttgggaaggcagtggttaaaatcgtttgattaagaacggtacaaaaagtaccaactaataaaactgcaatgagcaagccacggttataaggcttcccatgcgtatcaacaggagttgacaagtaaatcccttctctctaaaaaagtacgttgtctaatataatcggatttatcggctttgtcaacaaacttgacattaatattaaaaataatatactgagtattgaaaatgttagaaaagaggttgacccgtggataagcaagaagacggtgtattttttaagaaatttaaagaacagctgggtaagcatcaattcacaatcggaattagcgatttggcgaagatgaccggcgtctctcagacacagctacgttactgggaacagaaaaattatattcatagtcttaaagtgagtgagaagaataccacgcatcgttattcgtatggtatgctgatgcgtgttcattttatcaagatgatgttagacgagggttttacactggcagcggctgtcgagcgggccgatgggtataataaccaaatggaaatgatgcgcatctttatgatgacggcttttcaaggaatcgaagaacgggatggtcaccacatggtcaagttgggatattttgacgaagcgaagacacaacagctttattgttatattcaagatgagacgccacattatcgactttatcccgttaagtcagagcgctagcaaccttcagcttgtgtaaccgattaattaatgttaaatttaagttggtaaatgtcggtaagtcacttgggcatttaagtttcccgttcgtcaaccgatcttatggctgggttgaccgttgtcatgttggtcgtgttttgaagtttaactttgcaaaaggatttacaacggagcgcgaataagcgctgagagatgcctagctagaactaggtagtaatcgtgcataaaacaacgtgtaattgaaactagtagtagtcttcaatcgcccggtgatgatatttaccagaggtcccaagtgctgcgggaaagcttggggcttttttgtactttcgtacgttaaaacgtaatctatcagtgtggttatcaacaaaaaagagaccgagtatcaactcaatctctttaaataatctataagtacgcgtggtgcttgtctttcatttagtattaattctacttctatatgaaataatcacgagtagcgcgcgttaattaagtaggaattgttaagatgtcgcagtttgagcaaacttggcggctaaccattcattccatggtagtgctggattaccactagtaaagtattgttgatcgagtcgatcaatcaagttgacgtaggcggtaaatgaaaaattaacggtgtcactcaagcgctgagccttggtcatgtagcggccataagtaaggtgttcattgatgtctgtcatatagctggcaacatcatagttggacatcatttcaaggttgttagcgtcaaaaagtggtaagtagaatgcggcaaagtcttcaactgccttgtgctgcaaagaactatccaattgcgtaattgataattgagcatcatcattcacgatgcggttcctccttagttgaacaagcacgtttctaaattagtaaccaaattggttattttgcgctacaattaattatgtcacgattaggcaattatttcaaagctttgtcgttattagagactagaactggtgtctcaattgtagtaagatgttagaattatattagagagaatcagaagtaactatttagttgaggtgaagaatattcatgacccccatgaaggaagattacttaaaaattattttcgagcttggtggtacgaaaaaaaaggtgtcgaataagcaaattgccttaagtttagacatcgcggccggctctgtaacggagatggtcggtaaattagttcaggaaggcttggctaagcataccccgtatgctgggatttcgttaacaaagaaaggcattcgctacgctgaaacgttagttcgcaagcaccgaatctgggaagatttcttagttgataaattggattatgatttgccagacgtgcatacggaagcggaagtgctggagcatgtgaccagtgaacgactagtggattctttggaagcctttttaggcaatccgacgcattgtccgcatggtggcgcgattcccgataaggatggtcattatcaggaagacagtcatgtgagtttagcagatacgcaggatggcacaacggttacgattgagcgatttattgataatcatgatttattagtttatttgcatgatacaccgctcaagattggacagcaggtcacggttttaaagcacgatccatttgaaggccctgttaccgtttccattcagaaaacgggcgaggaaatcccagttagctataaagcggcgcacaatgtctttgtaaagtaagcatgcggcgcctatttccgaacaaacctgttaattgttagttagttattctgtttcatttatcatcacataaacatttcatggaaatcatggtgtttggctaccctttttagaaacaatatgctacaattgttcttgtagcttggttaggtaattttggtcagatcgtttcaataaactatccccatttgtaccgaatcatgatttacattattttatacgtgcaaaatgcactaggaggattttttattatggaacacggaacagttaaatggttcaacgctgataagggttttggttttatcactcgcgaaaacggtagcgatgtattcgtacatttctcagctatccaagaagacggcttcaagagtcttgatgaaggccaagctgtaaacttcgacgttgaagaaagcgatcgtggcccacaagcagttaacgttacaaaagcataattaacagcttaaatggcttaaaccggtgatgagaattaattctcatcaccggttttttgtcgttttgcagcggatgcttaattatcataaataaagctttactaacagccagacattggctaaagtaagaattattagagaatgtaattctgattattaaagggtgggatgacagtgacaaccgatgagatgattattgcgacttgcttgaaggctggtaaaatcatggtcgagaatggttcggagatttcgcgagtagatgatacgatgatgcggattgctcagaatgcgggggttgttgctgccaatacctacgtgacgattacgggtgtcatgatgtcgattcaaggacgtaatgcaacgcagattgccgcggttaaccagcgaacgatcgatcttgaaaaagtggcacaggtcaatcagttatcccgtgaatttgcggctacgaccattgatttaccaactttatatcaacggcttaatcagttagatgcagcttcgcgctcatttccgttgtggttgcagttggtcggtgcagccttagtcagtggccccttgatgattatgtttcgtcaggaaattgttaatacgtggccaactgttattattggaacattaggttacttggtcttttatctgcttaaccggtatcttaaaattaaatttttgagcgagttaacggcggcacttctaattgggtttggcgcggaatgggtgtgtcagattgggtggggaaccaatgtcaatgatattattatcgggtcgttgatgccactagtgcccggagtgccattaacaaacgccgtacgagatactctggctggtaatttcgtcagtgggcctgcacgtggcgtggaagcgatgctgagtgcggcagcactaggctttgggatcgccgttgtcattacattattttaagtacgggcactagcctgggtattcggagggatcatgatgggcacaattggacaattagtgctggcttacattgcggtactggggtttggcctgattattaatattccgcatcaagcgttaaacgttgcgggctggattggtaccctaacgtggggtggctatttgattgttcaggcttttgatggtggggtcgtcttaggaagcttaattggctcggtcggtattggcgtcctcagcagcttagcagctcgctacaagaagatgcccgctattatcttcaatattccgagtttagtttcattcgtgcccggcagtcaggcttatcagatggtgcgtaactttgcgctgggtaattatcgtgaggcggtttcattcacgttgcaagtgattatgattactggtgcgattgcattgggattcttattagctgaattactcaaccggcttatcgcattttgtattcgccagtggcggttgcaccgattggagtcgtaacctaactgttggctgattagttgtgaatcgtgaacaaagtttgcggacgctaagactaagcgccataaataaattccgccaaaagtggtgggttagtgcgactaatttgccgtgtgccagcgttctgaatagttacgcgcttagattagttattacgactcgcattcaatacagaaaaagcgccaactgaactgctctactaagcagttcagttggcgctttttaattagttagctgagacatcgcaacaagtagtcacgactcttatcatcaaatcagatggttagttttggttagcaaatttttcgccggttgtcgcagcctttaaattaagggacttacgtaagacgttcgtgacccgttgcttttcagattgcgaaacaacttcgaaagactgaccatcaatcatcttaccagtaccctgggcgtgatcagagacgatattcttggttgcactacggtaattagtgacgatactagttaaattaccgaatgttaagtcagtccgtgtttgtttagcaagtgaatttaagaaatcttgtttaagcaagttggaagcactggcgctttctccgataatggcggtgattaattgccgttgccgctgttgccgaccatagtcgccgagtggatcatcataacgcatccgggaataggccaaggctttggcaccattcatatgttctttttggcccttagtaaaggtgtaaccttcgtaggtaaatgtccgaattggagtaatgtcaacgccaccgatttcatccacaacttttttcatgccacccatgttgatcagggcgtaatagtcgattggaacgttcaaccatttttgaacggtcttgatggtcgttccggcactaccataagcgtaggcagcgtttaacttagtcgggaagtcctgttcgaaaccggagacagccacttcagaatcacgtggtaaactcatcagggtcgttgtcttagtcttggggttgatcgttgctaagatgatcgtatcggtccggcctttatagttccgcccgagagccccggtatcagttccgagtaataggatcgagacgggtttcttgccattcaatacggcgctcgtattccgactctttttaataccactactcttgaagacggtgtcggccgcattcttggcgttaaaataagttcgcgcggcaaaggccccggtcccaactaataacacggcaataatgattaaaacggtattgcgaacggggtgcttcttcttgggcccgttgccgttcccctgtgaattgtttccttgtgatttctcacgatgcatttctgagcgacttggcatgtcttccatgaactcttcctccaatggtaatagttattcatagtttagcattttttcgggtcagcgggaactgaatccacgtaagatttagcttgattaccgatgactgtcagataaatcataacctttttgttaataaaacgtgattaaaatgggaattctttgtttttttttaatgttccctgagagatattaatgattcgttcagtcgattaatagactatggtataattttgttaattttaatattaaatgggggttcttgttttgatgatcgataagtcgcgtagtcggccgatcaagtttgtcattggggtaattttatttgcctacttaagctattttattagtgacggcgcggttggtattgatttactagatgtggccttaacgtcgctggtccaaattagtaatagcggtatttggacggtattttataaggtgattgcttggttggcgtcacccggaatggacattttgtggatcgtcatcctggcgtttctaatgtacggatttaaatataagattcaagcgttctggacgctagcatatatggttggtgcaatggcgttaggctttattgtcaagcacatcatcggccgagcgcgaccaattggtcatttagcgcaggataccggatatagttatcccagtggtcacgttttaggaacctttgtgttggtcagcgtgattatcatgttgattgttcctgagttgccaagttatcgaatggcaatgatcgtcaagtgggtgagtgtcgtatggttagtattggtcattttctcacgtatttacttgaatgcacattatccaactgatacgattggggccgtgttgttggcatggtcttggagtcaaatcatgcaatggttctacgttttctgggcaccaggattattgaaatggccgttgttttatcgctcatatttataaagacaattaacaaacttaaactaatctattatttagcaggcaaccgtgtcactagataatagactcaaaataaaaaattgtttgctttaatcgacactactcggctgattgcgagaaattgatcgaagcaaacgattttttgtttacagctataaaatattaactagcaacgactggtaatgaactaacgattatcagctagccattcaagtgctaacgttaaccagtgggcgacgtgcggctgattggcgtctggtttccatgctgtttgtgcattcgcaagggctagtccgtgtgggccatgtttaaagacgtgtagttcataaggaatcttagcagttgctaacgcagtcgcgtaggcaagcgtattggttgctggaacaattgggtcgtcagccgttgtccagataaaagtcggctgattatctgaattgacgtgttggtcagcggccagttcgttcggcgttggtgtccaggtagccaaggtcgcgtcatccttgggaaaacctagcaatggactgatgactggatagccgagtaccacgttattcggctttaacatggcgggcgttacgtttaattcagttgccacgcgggtcgcccagtaatcgttatacagtgccacaatgtgaccacccacgctaaaaccagcaggcgtgatctgttgcggatcaatatgccattcggccgcgtgttgacgaagcaagttgactgctcgtcctaaatctaatacgggtgctaatccgagtggttgttgatcagtgagtagcgtatattccaagtaaaaggcctggtaaccgtgcccagcgaaagccatggcgagactctctgcttgcgccactggaatatgcgtgtatgagccgcccggaacgataataatggcgggtaagttcgtttggtgtgcgttcgtatccggttgatgcaaataaccggtcaattgcgcgcacgtcgctgttaatttttgcttaataacttgcatgcaatcacctcaatttgatatggttaacataactattataacgcaagtcaggtggaacagatatgggcatggttacggttacaactcggaatgagcaactcgagttacggccatttacgttggcagatacagaggattattatgacttagttcgtgatccgtcaattgcggcatcggcgggctttacgccagcgcacagcttagtggaagccgaattcttattgaaacagcaagcgaagttaccacagatttttgcgattgaactaacagcgatccaccgcgtgattggcagtgtggggttgtatgagcgcatgacgaatacgggcgaaccagcaactttagagatggatctcgggtatatgttgaacgctcgatattgggggcggggcattatgacggcagcagttgcacgtattttacgatacgggtttgaaacgcttcatttgcggcggatcacagccagttgtctagctaataatccggcgtctaagcgaatcttagagcatgctaattttcgacagtatgatgctgttcgccatccagattacgccccgtttggcgctggtcagacggagttattctttgattgtgtggaattaaacctttaggaggtgagttaatgcaactcgcaaaatcgtttgaacaggccgcctgcgtgttggtattgttggctacacagcaaccggagattccgttgactgcggatgtcttgcacgagcgaattggtggttccgcttcgtatattcgtaagattattcgtaaattagtagtggcaggactggtcacgtccaccagtggaaataacgggggtgtccacttggcacgctcacctgaggacatttcaattacagatgtggtcgcggccatcgaggggacgttgcagacctttccgaattatggttattttgaccgagtatttaaggacgttgaaccggtcgctcatgaagggacgaaagtggtcaacgggattttttcgcgagcggatcaattatggttagattttttagaccagcaaaaactggcgacgttgatcaaggaattattagttgttactcaaatcccagtgttggattggacgaattactcagatgataaaatggcccaattaaatgcgttgcttagtcggatgcgggcacataagtgagacgtcgtacaaactcgataaaaattgggagcggtttcgcttggtaaaccaatattgacgcgcttttgccaatcggggatcattttcaaaatgatacactttatttcacaaggctgaaaatgctgttattaaagcgttttttatggtattctaacaatgaatttcacaagatagaggggaacaacatgccagataagaaatattacggggccgatgcgatcgtcgacagccttgtaaaccacgacgttaagtacgtattcgggattccaggcgctaagatcgatcgggtctttgagcgcttggagcacccagtcaacccgaaaagtccgcggttgatcgtgacgcggcatgaacagaatgccgcgtttatcgctgccggaatcggtcggattactgggaaacctggtgtagtgatgacaacatctggccccggtgccagcaatttagccacggggctcgtaacggcaactgctgaaggtgacccagtcttggcaatttctggtcaagttcagcgtgctgacttgttacggttgacccaccaaagtatgaataacgcggcactatttaagccgattacaaagtacagtgcggaagttcaagaaccggaaaatatttcggaagtgctcgcaaacgcctaccaagaagccacagctgctaagcagggtgccagctttgttagtgtgccacaagatgtcactgattcgattgtacgcacacctgttattacaccaatccaagcacctaagttagggcctgctagcccggtcgaagccacgttattagcacaaaaaatcaaagcagctaagttgccggtcttgctagtcgggatgcgggcttcttcaccagaagtgacgaaagcaattcggaacttggtggctgctgctaatctaccagttgtcgagactttccaagcggccggcgtgatttcacgtgatttggaagccaaccatttcttcggtcgggtcgggttattccgtaaccaaccaggggatatgttactaaagaagtccgacttagtgattgcggtcggttatgacccgattgaatatgaaccccgcaactggaatgcggaaggcaaatcccgtatcgtggttatcgatgcaatgcgcgctgaaattgatcataatttccaaccggaaaccgaattgatcggtgatattgcccagacgttagactttttgttgccgtacatgaagggctatgatattagcgatagtgcgcgagcttacttgggtgaattacaagaacggcttcagacgcgtgatttcgtacctaatattgataagcagtccaagttaaatcatccgctgtcagtaattgcagccttacaacaacgggtcagtgatgacatgacagtgacggtcgatgtcggcagtcattatatctggatggcgcgtcactttcggagctatgaaccacggcacttgttgttcagtaatgggatgcaaacgctaggggtggccttaccttgggcaatcgcagcggctttggttcgtccagatacgcaaatcgtgtctgtctctggtgatggtggtttcctattttccgcccaagagctggaaacggctgttcgactgaagcaaaataccgttcatttgatctggaatgatggcacctacgatatggttaaattccaagaagaaatgaagtatggcgaggatgcagcggtccactttggcccagttgattttgtgaagtatgctgaaagctttggtgcgactggcttgcgggtaaaccaacctgctgatttggaaaaagtgcttgatcaggcctttgccacggatggtccagttgtggtggatattccaattgattattctgataacaaagcgttaggcaagacaatgttaccagaccagttttattaaaattaacattagtgaccggttgtcaaaagatggtcggtcagatataatagttgagtatatcgaaagaagaggatgcggttaacaatagtagccggctggaagtgggtcaccacttatgaaggtcagtgaacggggcaaccgccgaaatcgatggatcagtgaccgattcatccgttgggccttggttgaataaatcatggactgtcgcagctagaatagttgcggggcgctatcgacgatgaaatcagcaattatgtcaatcaatctgattaaagtctttttgcgcacgttatcgtgaggcaaagaggctttttattttgattgtgctaacctgaatcggtgtgaacacttttagatataaatcgatttttggaggttctgcaatggcagaaaaacaacatcaggaagtgcatcgttccttacagacgcggcatttatccatgattgcattaggtggtagtatcgggaccgggctgtttgtcgcgtccggttcggcaatttcaacggctgggccagggggagcattactggcctacgttggtattggagtgatggtttactttttaatgactagtctgggcgaaatggcaacttatttgcccgtttcaggttcgttttccacgtatgccacgaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgtcttgatttttatgatcaacgcgctgtcagtccggtcgtttggagaaactgagtactggctttcgctaattaaagtggtgaccgtgctcgtattcttggttatcggtgtcttgacgatcgtgggaatcatgggcggtcatgccactggcctcagtaactttacctataaaaaggcaccatttgtcggtggaattccaacgattttgagtgtcttcgtggtcgctggtttttcgtttcaaggaaccgaattaattgggatcacggccggggagtcagcaacaccggagaaaagtattccggcggctattaaacaagttttctggcgtattttgttattttacattttagccattttcgtgattgcggcgattattccttatacgtcgaaagatcttctagggtcatcagcgagcgatattgccatcagtccgttcacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtcgggtcaatcgtcgtgggattccaatcatggcattattaggaacgacggtgattggattactcacgttcttgtcgagtctattcggtgaacggatttatattttcctcgtttcggccagtgggttaacgggctttatcgcttggctaggaatcgctatttcgcatctgcgtttccgtcgcgcgtttgttaagcaggggcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgctatcatactaagatgattccgctagacaaggttgatttgacacgcaaacgacatcatcaagattaagcacgcactttgatagtttgagtaaatgcggttgacactgggtcaatcgcattttttgacggcgagagttggacctgtcaactcaaggcgcggtcgtatttttaggtgtcctgatttatgctgataacactgctcacaacagatggtcacggcggatcgttatgaatgggggcttgcacgattgtaatgatagcaagcggcaaattgagggtgcgctaatctgatatctatggtaatttgatagaatgagaatatggaatcattaaaaattcgcaaacttatccttaagaataggctagtcggctatgactatgctaagctgaaatgagaaaggcagcgagagagatgttaaagagaaatttgttaagaggtctagcattagtgtcattagcaggtgtcctggctggctgtggtgctagccagtcgacgtctaaagcgactagtagttctacgagtgctaagtcgacgaagacacagaccaagcggcaacgactgattagtgccttaccgaaaggcgttaaatcgaccgatagcgacttagtggtcgtcaataagtggcataagcgcgctgagatgacatttaataagtcgagcgtggatggtattgaagtccgtagttctatcgtcaaaccattggaagcctttctagcgggggcaaaaaaagccggctatccagcaacaatcgtgtctgggtatcgttcagttgcttatcaaaaagaggtttgggatcagtcgattcaaacctatgagaatcaaggaaaatcagccaaggaagccttaaagctgactaaagaatatgtcgcagttcctagtggtagtgagcatgaaactggtctcgcagcagatatcatgaacacgcactggtacagcactcatggtaatcaattattgtcatcatccgacaagaacaagggtcagcagtggttgattaatcacgcggcggactatggatttgtgttgcgctttactaaagatggtaagcagtcgaccgggattgactatgaatcttggcatttccgttacgttggtaaggcgagtgcggaattcatgactaagcacaatttgactctcgaacagtacgtcagcttgctgcaagctcgagaaaaggcggccaagtaataagctagccgtattattgatgaccgcccccaattaatactatattatggcgtacgttaggaattagctagcgtgcgcttttaaattgtcttcggtttagcaatgtgggttcgtctcaactgagtattatttggtcacgacacgttgtcgcttgattatgctggtcagaggccgcactcaaagctgaagtgccaccagcgccggcttgggtaacccagtgtgtgttagtgagttgcttggatcgctgactagtgcgtcgcagttgtggctggtgcgaagttttttactgaattggctcaccagatattgcattttaagacgtgggtgcgtacaatatgtagtgttgcttttagagataatcaaaattttgacgtgattaaaaggagagacgccccatgcttgtaatgtcaggaacaatcggtgccggcaagacgagtttaacgcagttagtggctaaccactttggttctaaagcgttttacgagtcagttgatgataatcccattttgccgttattttataaggatcctaagaagtacgccttcttattacaaatctattttttaaataaacggttagacagtattaaatcagcttttgctaacgatctggacgtcttagaccggtcgatttttgaagattcattattatttcatttgaatggtgatcttggccgggcgacgaataccgaagttgacatttatgattcattattagataacatgatgcaggaattgccagaagcgtctcatcaaaagagtcctgatttacttattcatatcaatatttcttttgatacgatgctcaaacgaatccaaaagcggggccgttcttacgaacaaattgatcaagatcctgatttatataaatattatcagactttgaatgaacgctatgacgactggtacgctaattatgatcatagcccgaagatgcagatcgacggggatcagctggactttgtcgccgatgcggatgcgcgtaaggaagtcattcggttgatcgacgaaaaagtggctagtttaggctagttgcctttttagaatcaatgttttatagtagacagtgaatattaaacacggcgcgtttttaagtagacgttcagagaaccggtgggtggtgtgaatcggtagtcgaaactccggcgcgacaatgtgggcaggtaatactgcacggcacggccgttatccgtttaagggtgggattaatcatgatcctgaacttgggtggtaccgcgaatcgcagtctcttcgtcccaattgggaggagagactgtttttatttacgattaaaagtgaaaaggagacgtcgttatgttagatgttaaaatgattcgtcaaaatccagattttgtaaaagaacagcttggtcatcggggcgttgctgcgagtgacatcgatgatttattggccgctgatgaaaagcgtcgtgaattgatcgccaagagcgaacaattgaagtcgacgcgtaaccaagtttcaggcgaaatttcacagaagaagcggaacaaggaagacgctagtgccgaaattgcagaaatgcaaaaagttagcgccgatgtgaagacgttggatgaagaacggcggacagtcgatgcccaagttcaggatatggctgcacatttaccaaacatgccccatcccgacgtaccagttagcttgaaagaagaagatgccgttgaattacgtcgaatcgggacaccacggcattttgactttacgccgaaagcacattgggatatcggtgaagatttaggcatcttagactttgagcgcggtgctaaggtttctggtagtcgtttcttatactacgtgggcgatggtgctaaactggaacgcgccgtttacaactttttcttagaccagcacgaagctgaagggtatacggaagttttgccgccatacatggtcactgatgaatctatgtacggtaccggccaatttcctaagttcaaggaagacgctttccggattacgacgcaagatttgacgttgattccaacggccgaggtgccattagtcaactattatcgtgatgaagttattccagctgaaaaattaccagtttactttacggccttatcaccagccttccgtgaagaagctggtagtgctggtcgtgatacgaaaggcttgattcgcttacaccaattcaataaggttgaaatggttaagttcacgaaaccagaagattcatgggatgaattagagaagttgaccaacaatgccgaatcattgctaaagaaacttgggttaccatatcacgttattacgttaacgactggtgacatgagcttcacagctgccatgacacatgacttggaagtttggttcccagaacaagacaagtaccgggaaatctcgagttgttcaaattgtactgatttccaagctcggcgggcgcacattcaatatcgcgatgacgatggcaaattgcaattcgttcatactttgaacgggagtggcttagctgtcggtcggaccgttgcagctattttggaaaactatcaaaatgaagatgggacggttacgattccagatgtattagttccatatatgcacggtaagacgaagattgaaaaacaaggttaattgagatgaagttagcgaactcgcagtgatgcgagttcgctttttttgcataattaatgagtattaaagggaactgtcgattttaaaatgtgagtggaaataacggccgagttgactaaataattgcgggacgggcagaatgtcgggacaacatttcaggcgcaaaagggcgaaaaagctgggtttactgaaatttattcacctttttttgaaaatagggtttgctattttcggctaccgtgctataatatttcttgtcggaaaaatataacttgtttatccagtaaaaagtatatttatccatttatttgaaaaaagttgttgacaagtattcaacatgatgataaagttaaatagttgtcaaggcataccagtaagaactgtttgaaccggcaacaaggcatgattaacatcatgcgggtgtggcggaactggcagacgcgctagatttaggttctagtgtcttacgacgtgggggttcgagtcccttcacccgcacatgccgacttagctcagttggcagagcatctcactagtaatgaggaggtcggaggttcgaatcctctagtcggcatttacaatttaatagctttattatgcggaagtagttcagtggtagaacatcaccttgccatggtgggggtcgcgggttcgaatcccgtcttccgcttttaatttgccggggtggcggaattggcagacgcacaggacttaaaatcctgcggttagtgataaccgtaccggttcgatcccggtcctcggcattttaaataagcacccatagcgcaattggatagagtgtctgactacgaatcagaaggttgtaggttcgactcctactgggtgcattagtatcgggaaatagctcagcttggtagagcacctggtttgggaccagggggtcgcaggttcgaatcctgttttcccgatcgtttaacacagtcttagttaagtgctaaggctttttatttaattttctcgggaagtagctcagcttggtagagcactacgttcgggacgtaggggtcgcaggttcaaatcctgttttcccgattacggttaaaccaactaatccagtcatttggctggattttttttatggccttttttgtaagcaggggtgtttcaacggtcaggggacacttttgcgacgttactcactaagtcagccatgtgaagaatacggtggttgtgactcataatcccgacaaggcaacagccactgttagtcatgagctcggagaaattagtctcggaactgctgttcatcgttgtgataccagtgcccatcgcctgcaatgaggagtgactcaacttgacatattttaaataggtagttcaatgaatatggagacctaataatttaatcattatgaggttctaaacggttgaatcaattgaaagcaaacgtttggcgtgctatgctgtaacaaccgttaagcacatgctagtccgcggtttgggtgaaattctttgcttttttccattatcctcgtataataatagtcaatattagtcaaagataatgaaaagggtgaagcacatgcaaagtcaaaatatctcggatattattgaaaagtatttaaaaagtattttggcggactcggagcatgttgaaattcgacggtcagaaattgccgaccttttcaacgtggtaccctcacagattaattatgtgattaagacccggtttacgatccaaaatggttacttagttgaaagtaaacgtggcggtggtggttatattcgcattgagaaggttaatttggtcgatgatgctgatgtgttggacgccctcatacaggtgatcggcgattcaatcacacaacgagatgcttatgcggtcgtccaaagtttatacgaggacgacgtcttaaatcgtcgagaagcgcaattgattttagtggcgattgaccacgagacgttaggattaacggaccgggacttagaaaacagtctgcgggcccggataattatcggaatcttgaaccacttgcgttacgaaagctaaagaaagcgaggaatcgcaatggataacttatttacacctagtgccaaaagtgtgctggtactggcacaggaacaggccaaatatttcaagcatcaggcagttggtacggagcatttgctattagcattggccatcgaaaagaatggaattgctaataaggtgctacaacaatatgccgttagtgaagatgacattcgtgaagaaatcgaacggttcactggctatgggacgttgagcaatgttggcaaggatacttacttgccatattcaccaaaggccaaagaaattttgtccgttgccggtgatgaagcaaaacggctcggtgccaacaagattggaacggaacatttgttgttagcgatgctctctgatgaaagtatcctttcctcgcgaattttaatgaatttaaacttagatctaggtcagacgcgtaaagtcgttcttcgcaagctaggtgtcagtgacgccatgagtaagcgcaagggtaacgcggctaatcgcggtggcaagaagactgaaggaacgccaaccttggattctctggcgcgcgatttgacccaattagctagtgaacaagaaatggacccggtagtaggtcgttccaaggaagtcaaacgggtcattcagatcctgtcacggcggacgaagaataatccggtcttgattggtgaacctggggttgggaagactgcaatcgccgaaggtctagcccaaaagattgtggccggtgatgtgccaactgatatggcagataagcgcttgatgatgctcgatatggggtcactagtcgctgggacaaagtatcgtggtgaattcgaagaccgcctgaaaaaagtgattgatgaaatttacaacgatggccatgtgatcttatttatcgatgaattgcataccttgattggtgccggtggtgctgaaggggctattgatgcctctaatattctgaaacccgcacttgcacgaggggaactccaaacgattggggcaaccactttaaatgagtatcaaaagtacattgaatctgacgctgcgttggaacggcgttttgcaacggtcatggtcaatgaaccgaccgaagacgaagccgttgaaatcttagatggactacggccacgctatgaagaacatcatcgggttacgattacggatgaagctgttgatcaagcagtcaagctatccagccggtatatcagtgatcgtttcttgcctgataaggccattgacttgatggatgaggcggcagctaaagtccgcatcgatcagatggatcaaccaacgaagctatccaagaaccaggacaagttagcgcaactgcgtgaggataaggaaacagcgatcgaagcacaagattttgaacaggccgctgatattcgtaagcaggagatgcaactgaagcaacgcctagatcgaatcgaagctgaccaagacgccgaagtgactgagggggcaacaccacactatgatttacaagtcacaggtgaggatattgctcaggtcgttgccgaatggaccggggttccgttaacgcaattgcaaaaatctgaaagtgaacgcttagttaacttggaaaagattttgcatgaacgggttgttggacagccagaagccgtatccgcagtggctcgtgctattcgccgtgcgcgcagcgggttgaaagatccgagtcggccaattggttcctttatgttcttaggaccaactggggttggtaagacggagctagcaaaagccttggcagcagcgatgttcgggtctgaagataatatgattcggatcgacatgtctgaatacatggaacgctattcgactagtcgtttgattggctcggcacctggttacgttggttatgacgagggcggtcagctgacagagaaggttcgccagaaaccatactcggtcgtgctatttgatgaagttgaaaaagctcatccggacgtctttaacattttgttacaagttttggatgacggctacttgacggattctaagggtcggaaggtagacttcagaaatacgattctgattatgacgtcgaaccttggggcaaccacacttcgtgatgaaaaatcagttggttttggtgcaactgataaggccaatgactacaatgcggttgctgcgacgattcgagcaacgttaaaacagacgttccgcccagaattcttaaaccggatcgacgaaacaatcgtcttccattcattgaataaggaagaattacacgaaatcgttaagttgatgtcacaagaaattgttgatcgagtggcccaacaaggtatcaagatcaaaatcactccggctgccattgacgtggttgcgaaggctggctttgaccctgagtacggagcacgaccaattcgacgggcattacagactgaaatcgaagatcggttgagtgaagaattattgaccggcgcgatcaaggtcgatgaccaagttacgattggtgctagcaagggtaccattacaattaatattaaaaaccagcctaaggcagatggtcgttcgaccgtttcctcaaagtaggcgcgattaaattaaagatgacgcttgaagtggtagtccacttcaggcgtcatcttttaggttcaatcggtattaagatgctacccactgaagtgaactgtaggatctgaggctggtggttcggtgctgattggtgtaaattataataggaaataaagtcaagaaagaagatgataacatggcgacacgagccgaacagatggcgaagacgcaccaggcgattttagacacagcccgggaactgtttttaagaaatgggtatgatgcgacaagtacgcgcgacattgcgaatgcgattggcattacgcagcccgcgctttatcaccattttaaagataaagaggtcatctttctggctgtcattacgacggtcggtgcggaaatcaaggctggcattgaagcgattcaagtccgtgcggattggtctccgttggatcaattaacagaagtctcgctattactaacgcataagcatccggctgatgtcttcacgttaattcattccagtttcaaagcattaacgcatgaacatattcgcgagttgggcggcatatttgttactgattatgtgaagccgattcaaaccgtttttgagcaacctgacatgcaactacatgtgggggtcacaccacagatggcgacgaatttctatatcaccagcttgagtccactgtttaacagttttcatcaaatcggtgatcctcatgctgacgagcggacccgcgttcaaactcttttaaagatgatcttatacggggttgcgagtgaaccagaaaactaatggcggcagagaagtctactagttgacaactaacgttattcgatgtatattataacttgtctgtaaccgtgaactcgagcgaacgcgcaatctattgtctgtgcggctcgttaatataaatccaaaaatagtcaacttaagcgactatttttggtttttttatgcctaaaattcggtcaaaaacgcatttgtaacacaaatgtaatatttgaccggaggtggcgggttccggaataataagaaggggtgaacaacttggccggacatttagtaaaatacggtaaacaccgtacccgtagaagttatgcacgtatcaaggaagttcttgatttgcctaacttgatcgaaatccagaccgattcttaccaatggttcttggatgaaggtctccgggaaatgtttgaagatattatgccgatcgacgatttcgcaggaaaactttcacttgaatttgtcgactatcaattattagaaccaaagtacaccgtcgaagaagctcgtgaacatgatgccaactactcggcaccattgcacgttaccctacgtttaactaaccatgaaactggtgaaattaagtcgcaagacgtattcttcggtgattttccattaatgactgaacaagggacgtttattatcaacggtgccgaacgggtcattgtttcacaattggttcgttcacccggcgtttacttcaatgaagaattagataaaaatgggcgtcctagctacggcacaacggttattcctaaccggggtgcttggttagaacttgaaactgacgccaagaatgtctcatacgtacggatcgaccgtacgcggaagattccattgacggaattagtccgggccttaggctatggttctgacgatgacattattgacatgttgggtgaaactgacagtttgatgttgacgttggaaaaggacgttcataagaacaccgacgactcccgggttgaagaatccttaaaagatatctacgaacggctacgtcctggtgaacctaagacggctgacagttcgcggagcctattgactgctcggttcttcgatccaaaacggtatgacttcgcaccagttggtcgctacaaggttaacaagaagttaagcatgaagacgcgcttaatggaccaaacgttagctgagacattagctgatcctgatactggtgaagttattgcgcaaaaggatacggtcattgacaagaatgtcatggctaaactatccccatacttggaacgtgacgactttaagacggttacttacacaccatctgacgaagccgttgttacgaatccaatggtcttacaagttgttaaggtttattcacaaaacgaccctgaaaaggttgtgaacgtgattggtaatggcaacattgatttgaagttcaagcacattgtgcctgctgatatcattgcttccattaattacttcttcaacttgcaagaaggtcttggctcaaccgatgatattgatcacttgggtaaccggcggattcgttccgtgggtgaattattgcaaaaccaattccggattgggttatcccggatggaacgggttgtgcgtgaacggatgtcgattcaagatgctgcgacggtaacgccacaacaattgattaacattcgcccagtggttgcttcaattaaggaattctttgggtcatcacaattgtcacaattcatggaccaaaccaaccccttaggtgaattaacgcataagcggcgtttatcagccttaggacctggtggtttgactcgtgatcgggccggatatgaagttcgtgacgtgcactatacccactacggtcggatgtgcccaatcgaaacgcctgaaggccctaacattggtttgatcaacagtttgtcttcttatgcgaaggtcaaccgttacggcttcatcgaaacgccataccggcgtgtcgattggacaacgcataaggttaccgataagatcgactacttagcagccgatgaagaagaccaatttgtgattgcacaagccaactctccattgaatgatgatggttctttcgttgaagacactgttttagctcgtaacaaggaagaaaacttggaaacgccaatcgaaaatgtcgattacatggacgtttcgcctaaacaagtggttgccgtcgcaacggcatgtattcctttcttggaaaacgatgactctaaccgtgctttgatgggtgccaacatgcaacgacaagcggtgccgttacttgatcctcacgcgccattaattgggactgggattgaatataaagctgcacatgactcagggattgccttgatttgtcgtcatgaaggaacggttgaatacgttgatgctcgcgaagttcgcgttcgtcgcgatgatggttcattagacacttacaagttaatgaaattccgtcgttctaacggtggtaagaactataaccaacggccaatcgttaaagttggcgatcacgttgataacgatgaagtcttagccgatggtccagcaatggaaggtggggaattagcccttgggcaaaacccattagttgccttcatgacttggaatggttataacttcgaagatgccatcattattaatgaacgtttagtccgtgaagacgtctacacgtcaattcatattgaagaatatgaatcagaagcacgtgacaccaagcttggacctgaagaaatgactcgtgaaattcctaacgtcggggaagatgcattgaagaaccttgacgaagacgggattatccggattggggccgaagttaaagacggtgacatcttggttggtaaggtaacgcctaaaggggttacggaattgtcagctgaagaacggcttctccatgcgatctttggtgaaaaggcgcgtgaagttcgggatacgtcactccgggttcctcatggtggcggcggtatcatccaggacgttaagatcttcactcgtgaaaacggtgatgaattatctcctggcgttaacatgatggttcgggtctacatcgcacaaaagcggaagatccaagttggtgacaagatggccggtcggcatggtaacaaagggacggtttcaatcgtggttcctgaagaagacatgccgtacatgcctgatgggacaccaatcgatatcatgttaagcccaatgggtgtgccttctcgtatgaatatcgggcaagtgctcgaattgcatttggggatggctgctcggaagttaggaattcacatggcaacgcctgtctttgatggtgctcaagatacagatatttgggaagccattcgtgaagctggggttgattcagatgccaagtcgatcgtctatgatggtcggactggtgaaccgttcgataagcgggtcgctgttggggtcatgcactacatgaagcttagtcacatggttgacgataagatccatgctcgttcaatcggaccttactctttggttacgcaacaaccacttggtgggaaagcgcaatttgggggccaacgtttcggtgaaatggaagtttgggccttggaagcttatggtgcagcttataccttgcaggaaatcttgacttacaagtccgatgacgttgttggtcgggttaagacctatgaagcaatcgttaagggcgaaccaattccaaagcctggcgtaccggaatcattccgcgtgttggttaaggaattgcaagcactcggtcttgacatgaaagtcttggattctgaagacaaagaaatcgaattgcgggacatggatgatgatgacgatgaagttgtcaatgtcgatgcactcagcaagtttaaacaacaacaagatgagaaggctgcggacaaggccacaaaagctgacgccgctaagccttctgaaacaaccaacgctcagcaagataatcaataaaaagggaggtcggtcctttgatcgatgtcaacaagtttgaaagcatgcaaatcggtctggcatccccagacaagattcgcagctggtcatatggcgaagtcaaaaagccagaaaccattaactaccggacattgaaacctgaaaaagacggtctgtttgacgaacggatttttggtcctactaaggattgggaatgtgcttgtggtaaatacaaacggattcgttataagggtattgtctgtgaccgttgtggggtcgaagtgactcgtagtaaagtccgtcgtgaacggatgggtcatatcgaacttgccgcaccagttactcacatctggtactttaagggaattcctagccggatgggcttagtcttagacatgagtccccgggcacttgaagaaatcatttacttcgcttcatacgtcgttatcgaatctggtaatacgccacttgaaaagaagcaattactttctgaacgtgaataccgtgagaagaaggctcaatatggtaacgaatttgaagctgccatgggtgccgaagccatcaaacggttattgaataacgtggatcttgaaaaagaagcacgtgatttaaaggaaactctgaaggatgcttctggtcagaagcggacccgggccgttcggcggcttgatatcatcgaagctttcgtgacatctggtaacgaaccagcttggatggtaatggacgcaattccggttattcccccggacttacggccaatggttcaattggaaggtggtcgttttgccacctctgacttgaacgacttgtaccggcgggttatcaaccgtaataaccggttgaaacgcttgttggacttaaatgcacctgggattatcgtgcaaaacgaaaagcggatgttgcaagaagccgttgatgcgttgatcgataatggtcgtcgtggccgtcccgttgctggtcctggtaaccgaccattgaagtctctttcacacatgttgaaagggaagcaagggcggttccgtcaaaacttacttggtaagcgggttgactattctggtcgttcggttatcgatgttgggcctttcttgaagatgaaccaaatgggcttaccacgtcaaatggcgttggaattgttcaaaccgtttatcatgaaggaattggttaaacgtgaattagcttctaacatcaagaatgctaagcgaaagatcgaacatgctgatgacgatgtctggggtgtgttggaagacgttatcaaggaacatcctgttctcttgaaccgcgcccctacgcttcaccgtttagggattcaagctttcgaacccgtcttggttagtggtaaagcgatgcggctccatccattggcttgtgaagcttacaacgccgatttcgatggggaccaaatggctattcacgtcccactttcagatgaagcccaagctgaagcacggctcttaatgttggctgcccaccatattttggcgcctaaggacgggaaacccgttgttacgccatctcaagatatggttatcggtaactactacttgacgactgaagaaatcggtcgtgaaggcgaaggtatgatcttcaaggacttgaatgaagcgcaaaaggcttaccaatcaggttatgtacatttgcatagccgggtcggcattcaggtctcatcaatgcctgacaagccattcacggacgatcagaagcaagcagtcttagtcacgacggttggtaaggcaatcttcaacaacattttgcctggcaagttcccttacttgaacgaaccaactaacgataacttgattgctggtacaccggacaagtatttcttgaagcctggtgaagatattcatcaattcttggatgcccaggaaatcattccaccattcaagaagggcttcttggccgacattatcgctgaagtttacaagcaatatcacgtgacagcaacgtcactcttgcttgaccggatgaaggacttaggttacaacatttcaactaagtctggtttgacggttggggttgccgatattactggtttgaaagaaaaaccagcaattatcgccgaagcccataaacaagttaatacgatttcaaaacagttccgtcgtggtttaattactgatgacgaacgttatgaacgggtcattggtgtctggaacgacgctaaggaccaaatccaacaaaaactgattgaaagtttcaacgcggataacccaatctttatgatgagtgattctggtgcgcgtggtaacatttcaaactttactcagttagctgggatgcgtggtttgatggctgcccctaacggtaagatcatggaattaccaatcctttcaaacttccgtgaaggtttgtctgtcttggaaatgttcatttcaacccacggtgctcgtaaagggatgaccgatacggcgcttaagactgccaactcaggttacttgactcggcgtctggttgatgtggctcaagatgttatcgttcgtgaaaaggattgtgggactgaccgtgggttgcggattcacgcaatcatggaaggtaacgaagtcatcgaaccgttgtatgaccggatcttaggtcgttacacgatgaagactgtctttgatcctgaaacgcatgatgaaattgttggtaacaacgtcttgatcgacgaagacttagctcataaaatcgtggatgctggtgtaacggaagttacgatccgttctgcatttacttgcaacactaagcatggggtttgtgaacattgctacggccgtaacatggctactggtgatgaagttgaagttggtgaagctgttgggacagttgccgcacagtctatcggtgaacccggtactcagctgaccatgcggaacttccataccggtggtgttgccggggacgatattacccaagggttgcctcgtgtgcaagaaattgtggaatcacggaatcctaaagggcgtgccgaaatctcagaagttactgggacggttgaattaattgaagaaaatccagcggaacggacgaaggaagttacggttaagggtgaaactgatacccggacttacacgttgccgttaacagcacggatggcggttagtgaaggcgactttattcaccgtggtgctgcgttgaacattgggtcgatcgatcctaagcaattgattcaagtacgtgatgtcttatcaactgaaaactacttgctccgtgaagttcaaaaggtttatcggatgcaaggggttgaaattggtgataagcacgttgaaatcatgattcggcaaatgttacggaaggttcgggtcatggatccgggcgataccgacgtcttgcctgggacgttaatggatattgcagacttcaaggacgagaactacaagaccttgattgctggtggtattcctgcaacgtcacggccagtcattcttgggattactaaagccgctcttgaaacgaatagtttcttgtcagctgcttcattccaggaaacgacacgggtcttaactgatgctgctattcgtggtaagaacgatccactgatcgggcttaaggaaaatgttatcattggtaagatcattcctgctgggactggtatgccggtttaccgtcatatcaaaccaaaggaagttggcaacgtggctgatggggtttactcaatcagcgaccttgaaaaacaaatgcaagaacaagatgctagcaagtaattgctaagtaactaaaaagggcggccattgtggtcgtcctttttgtatgcacgattgtaggtaggctatctggggcgttcggcgatgaaggttaatcttcagggggagaagactaactgagcctcactggaaaagttcaagtttgtgtaaacttgcttagttagtgtgtcctgcactgcgctccaggcatttctgctaattgctggactgccgtgccttaatactatattggtgaaacgtgttcagattggaatgagactttcggttagctaacactaatcctcagtctcagcccgtctaaaccggacactcttgcagtgctaagaaacgtcttccgctcgggatggtgttcgaatggtgggcacgtgcgtacgcaacttttgacggattagtcgttacttttttgagaccggaatcttatcgggtaactttcaggttaataatagaattgtgagctgtccccgatttctaaatcaccatattactactgagggtcagaacaactgatacaatattaacgcttgtttaaagttccaagtagtaaacaattcgacaacaaattgtaccaagttgagtggtcgttcatccgcacaggacgcgtactgactaacaagcaataatcgggcgtactagaatattgcaattatagctcgctatgcgagacccgtgagttgggtgaccatgatgaagctccaactgatgaagggcacgaatggtaagcgatggcgtggggcactgatgataaaaccaactaatgcggcaacggccgcaatggcgagacaggtcaacagtgtgtcggctggaatgatgaagacaagcatgagtagaacgtcaacatcgccgagaccaaaggtggcagttagccgggccagcaagtataacccgactagtaaggcaagtacgaggtagagactgatcgtcaggggtggccgttgttgccataagcccagtccggctggaagaagtaatgtcagcgggtagacttcaaaagtgagataatcagtaagactattgaaaatcaataccaagtaaccaatcagaagtggcagcgtcaatgacaatgacgcactgctagaagctagtagactaccacaaagtaattcaatcagactggaacggaggctgataggagtgcgacaatcatagcactgtccccgttgaagtagaatgccgagtaatggtatcagttgccagaaccgtaattgatgccggcagtgtggacaccttgatcgttgagtgctaatgagtatgtgtccgttgctgatgcgttccgccatacaggtcacgaatgagcccagacagaggccaataataaaaagactgctggttaacatggaaggaccacctttcatcactagttacgcaatgtaaagcaccactattttttcaggacatttattgacaacttcggcatgtcatgatagtctagtaaaggtgctttttgcagacagattcctgtatcaggaatacagacatgctgactggtcggctaagcgcacaattaccatgctccaggcattcttttttactcaaaaaagaaccacctggatgtgtggacttaaaaaacagatatttggaaggaggacactttagaacatgccaacaattaatcaattaattcgcaaaggccgtaagtctaaagtatcaaaatcaaatgccccagcgttaaactttgggtataacagttacaagaaggttgcaactaataacccagcgccacaaaagcgtggggttgctactcgtgtcggtaccatgactcctaagaagcctaactcggctttacggaagtatgcccgtgtacgtttatctaacttaatcgaagttacagcttacattcctggtattggtcataacctccaagaacatagcgttgtcttaattcgtggtggtcgtgttaaggatttacctggtgttcgttaccatgttatccgtggtgctttggatactgctggtgtcgaagatcgtcgccaaagccgttccaagtatggtaccaagaagccaaagaaataataaggaggtaagttaaatgccaagaaaaggtgcacctgcaaaacgcgaagttttagcagatccaatgtataactctaaattagtaacgcgtttaattaaccacttaatgttagatggtaagcgcggtaccgcatcaactattttgtatgatgcttttgatcaaatcaaagaacaaactggtaacgatcctttggaagtcttcgaagaagctatgaagaacgttatgccagtacttgaagttaaggcccgccgtgttggtggttctaactaccaagttccaatcgaagttcgcccagatcgtaagacgactcttggccttcgttggatcgttcaatatgctcgctcacgtggcgaacacactatgtccgaccggttagctcgtgaaatcatggatgctgctaacaatactggtgcttcagttaagaagcgtgaagatactcaccggatggctgaagccaaccgtgccttcgcccattatcgttggtaatatttccgtgagatggttaaaggtcgcctttaactaatcacaaaaaggtgactattatatgcgcgcatatagtagtcattttttgaaataaactttatactgttaattccatttatattgagaggagtaacacattttctaatggctaatacacgagaattctcactcgataagacccgtaatattggtattatggcccatatcgatgctggtaagaccacgactactgaacggatcttgtactacactggtaaaattcacaaaattggtgaaacccatgatggtgcttcacaaatggactggatggcccaagaacaagaacgtgggatcaccattacctctgctgccacgactgcacagtggaagaaccaccggattaacatcatcgataccccagggcacgttgacttcactgttgaagttgaacgttcacttcgggttttagatggtgcgatcgccgtattggatgcccaatcaggtgttgaacctcaaactgaaacagtttggcgtcaagcatcaacgtataacgttccccggatcgttttcgttaacaagatggacaagattggtgcggacttcaagtactctgtaagcacgatccatgatcgtttacaagctaacgcccacgccatccaattaccaattggtgccgaagataatttcgaaggggtcattgacttaatcgaaatgaaggctgacctttatgatgaagatcaacttggtactgaatgggatacggttgacgttcctgatgaatacaaagaagaagcccaagctgcacgtgatgacttaatcgaagccttagctgacatcgatgacggcatcatggaaaagtaccttggcggtgaagaaatcagcaaagaagaaattaaggctgctatccgtaaaggaacgttagcacttgaattcttcccagtattagctggttcagccttcaagaacaagggtgttcaaatgttaatggatgccgttgtggactacttaccatcaccacttgatgttaagccatacaaggctactgatcctgaaactgaagaagaagttgacttgattgccggtgatgataagccattcgctgccttagcatttaaggttgctactgacccattcgttggtcgtttgactttcatccgggtataccaaggtactttggaatctggttcatatgtcttgaacgccactaaggacaaacgtgaacgggttggtcgtttacttcaaatgcattctaaccaacggaaagaaatcccagaagttttctctggtgatatcgccgctgcaattggtttgaagaacacgactactggtgactcattgacttcgattgaccatccatatcacttggaatcaatggaattccctgacccagttatccaggttgccgttgaacctaagactaaggctgaccaagataagatgaacgttgccttacaaaagctttctgaagaagatcctactttcaaggctgaaactaaccctgaaactggtgaaactttgatcgccgggatgggtgaattgcatttggatatcatcgttgaccggatgcggcgtgaatttaatgttgaagccactgttggtgcgcctcaagtttcataccgtgaaacctttactaagagcactcaagttcaaggtaagtttgttcaccaatctggtggtaaaggtcaatatggggatgtttgggttgaatttacacctaacgaagaaggtaaaggcttcgaattcgaagatgccatcgtcggtggggttgttcctcgtgaatacattccttcagttgaacaaggtttgaaggaagctatggctaacggtgtgttagctggttatcctttggttgacgttaaggctaagctctatgatggttcttaccatgatgtcgattctagtgaagcagccttcaagattgccgcatcattagcattgcggaatgccgttaagactgctggccctgttatccttgaacctatcatgaaggttgatatcgttgccccagaagattacttaggtgatgttatgggtcacgttactgctcgtcgtggtaacatcgaaggtatggaagaacgtgggaatgcccaagaagttcatgcatacgttcctttggctgaaatgtttggttatgcaaccacattacgttcagctactcaaggtcgtgggactttcacaatgacctttgatcattacgaaaaggtaccaaagtcagttcaagaagatatcatcaagaagaatggcggcactcctgccaaataagcttgattgataataagaaggacgttcagcttcggctggacgttctttttttacataaatttctggtcgaactaaatgtgattactgctcgtcgtaagacaacgtggcacatcaattgaagcggcttgggataatttggccgtcactggcattgggtacggctgtgacgagcacagtgctgctcaggcctgtgtcatcgcgcaagggtacaatcgcgcaacaagggtcgcactagttaagttactagccgctgcgaccataaaactggcagccataatattaaagggtgcgagattcatagcataataaggagaatgcggacaacatcacattttttgtaccggagataaccacatgagttgacggttgtcggtgaccacggccaaggtgctgacggtcggtggtaagcagatgacaatataatagaaggtagatgaacaagaacgtgggtcagtgtgacggcgccgtcagatgtaggagcagttgaattaagcgtgttgaagtccgattaaatgactccagacaaaaatgtatgacgctgaacgcgggtcttgttcctgagaaaatgttaatgcaatctagtaggtgtccacatgatcgtggccggtcgacagtgagaaatgtaaagcgctcaccaaaaagaaattaggcgcaaacgctattaattggatggaatttgtgttacattaattgagctggttcaaaaaggtaacacggtttacaacgatggttataaaaaaagtgcgaaaacacttgctattacagagcttttcatttattatagattgtgcttggtatttagaaggggataactatatccccatcatcaagtagtcgtagttagctttgatgtgaaaggttgcgacacgcccggccacattgtcatgggacgtggcggtaattttcacggagctagtcttattttcaaaatagacgaaggaggtcacaacaatggcaaagcaaaaaattcgtattcgcttaaaggcatacgaacaccgcattcttgatcagtcagctgacaagattgtcgaaacggcaaagagaactggtgctactatttcaggtcctattccattgcctactgaacggactatttataccgttctacgttcaccacataagtttaaggactcacgtgaacaattcgaaatgcggactcacaagcggttaatcgatatcgttaacccaacgcctaagacggtcgactcattaatgaagttagacttgcctagcggtgtagatattgaaatcaagctttaatttactaaactaaaatcaattaattggaggtgtactcatgaccactaaaggaatcttagggaaaaaggtaggaatgacgcaagtcttcactgaaagcggcgaattagttcccgttacagttgttgaagttcaacctaacgttgtgttgcaagttaagaccgttgaaaatgacggttacgaagcaatccaattaggtgttgacgacaaacgcgaagtcttgacgaacaaacctgctcaaggtcatgcagcaaaagcaaaaacgactcctaagcgcttcattcgtgaaattcgtaatgttgagcttggagattacacagtaggtgacgaagtcaaagcggatattttcgcagctggcgacgccgttgacgttacgggtatcactaaaggtcatggttaccaaggtaatatccataaggacggccaaagtcgtggaccaatggctcacggttctcgttaccatcgtcgtcctggttcaatgggtgccatcatcaaccgggtattcaaaggtaagaaattaccaggccggatgggtaatcaccaacgtacgatgcaaaacttacaaatcgttcgtgccgacgttgaaaacaacgttttattaattaaagggaatgtccctggcgccaacaagtcatttgtaacagttaaaacatctgttaagagtaaataaggaaggaggacataatacatgactagcgtagcattatttaaacaagacggtacgcaaaatggtgacgttactttgaacgacgctgtgtttggtgttgaaccaaacgaaaacgtggtttttgatgccatcttgatgcaacgtgcatcaatgcgtcaaggaactcacgcagttaagaaccgtagtgctcgtcgcggtggtggtcgtaaaccatggcgtcaaaagggtactggtcgtgcgcgtcaaggttctatccgttcaccacaatggcgtaaaggtgggattgtcttcggaccaacccctcgttcatacagttacaaattacctaagaaggttatgcgcttagctttgaagtctgtcctttcacaaaaggtcttagacaacagcttagttgcagttgatagcttagctttcgacgcaccaaagactaaggattttgtaaatgtattaaacaacctcaacgtcgataccaagactcttgttttggttgaagaggacaatgaaaaggctgctttggcaggtcgtaacttaccaaatgttaagatccttaaagccaaaggtgttaacgtcttagatgtcgctaatagtgacaaattagtcgttacccaaaaagccctcgatcaattagaggaggcgctcgcataatggaagcacgcgatgtaattttacgtcctgtagttactgaatcatcaatggctgacttggacgacaagcgctacacatttgatgtcaacgtacaggcaacgaaaacccaagttaaaaaagcaatcgaagaaatcttcgatgttaaagtcgttaaagtgaacgttatgaacgttaaaggaaaacttaagcgccaaggtcgttacgccggctacactaagaagcgtcgtaaggctattgttaccttaagttctgattctaacgaaatcaagttgttcaacgacgatcaacaataaatctaatttaggaggtaactctagtgggtattaagaagtataaaccaaccactaacggccgtcgtaatatgactgcttcagatttctctgaaatcactaagacgaagcctgaaaagtcattattagactcacaaagtcacactgccggtcgtaacagttatggtcacattactgttcgtcatcgtggcggcggtcataagcaacaataccgtttggttgactttaagcggattaaggatgaagttccagcaaccgttaaggcaatcgaatatgatcctaaccggacagctaacattgcattattagtttacgctgacggtgtgaaatcatatatcttagcaccaaaaggtttggaagttggtatgcaagttcaatcaggtgccgaagccgacatcaaggttggtaacgcattaccattaactaacatccctgttggtactgttattcacaacattgaattgaagccaggtaagggtggccaattagctcgctctgctggtacttcagcacaattactgggtaaggaaggcaagtacgcaattgttcgtttgtcttctggtgaagttcgtttagtattattaactagccgtgctactattggtactgttggtaatgaacaacacgaattaatcaactcaggtaaagccggtcgtacacgttggcaaggtaagcgcccaactgttcgtggttctgtaatgaaccctaacgatcaccctcatggtggtggtgaaggtaaagcaccaatcggtcatccatctccaatgtctccatggggtaagaagacgcttggtaagaagactcggaacaagaaggctcgttcaaacaagcttatcgttcgtggtcgccgtccaggcaaacactaataaaatttgaatttactgtagttatcgagaggaggtcacacgatgggtcgtagtttaaagaagggacctttcgcagatgcgcatttattaaagaaaatcgatgcacaatctgattctgacaagaaatctgtcatcaagacgtggtcacgtcgttcaacaattttcccaagttttatcgggtacacaatcgctgtttatgatggtcgcaagcatgtcccagtttacatccaagacgacatggtcggtcataagttaggtgaatttgtaccaacacggacgttccatggtcatggaactgacgataagaaaacgaagtaatagttaggaggatataaagaatggctgaacaagtaacatctgcacgtgcaactgcaaaaactgttcgtattgccgctcgtaaggtccgcctagttgtcgatcttatcagaggtaaaagtgttgccgaagccttagcaatcttgaagttcactccacggggtgcttctccagtagtagaaaaagttttactttctgctgttgctaacgctgaaaataactttgacttagatcgcgaagatttggtcgtaagcgaagcttttgttaacgaaggaccaaccttaaaacggttccgtccacgggcaaagggttctgcttcaccaatcaacaagcggactagccacattacgatcacagttactgaaaaataggagggataacgcgtgggtcaaaaagtaaatccaaccggattacgtgtaggaatcattcgcgactgggaagcaaaatggtacgctgaaaaagattttgctgcctacttgaacgaagatttacgcatccgtaagtatatcgaacaacgacttgccgacgcttccgtctccaccgttgaaatcgaacgcgctgcaaaccgcgtaaacatttcaatccataccgcaaaaccagggatggttattggtaagggtggttctgaagttgaagctcttcgtaaagaattaaacaatttaactggtaagcgagtacacatcaacatcatcgaaatcaagaagcctgatttagatgctaaattagttggtgaaagtattgcgcgtcaattggaaggccgggttgctttccgtcgtgcgatgcgtggtgctatgcaacgtacaatgcgttccggtgctaagggtattaagacacaagttgctggccgtttaaacggtgccgacatgtctcgtgttgaagcatactcagatggtacggttccattgcatacgcttcgtgctgacatcgactattcatgggtcgaagcacggacgacttacggtaaattaggtgttaagacctggatctaccgtggcgaaatcttgccagaaaagaaatctgctaaaggaggaaactaaacatgctggtacctaaacgggttaagtatcgtcgtgttcatcgtggtaaaatgcgcggtgaagctaaaggcggtaaaacagttgcttttggtgattacggtttacaaaccctcgaatcacactggatcagcaaccggcagattgaagctgcccgtgttgctatgaaccgttacatgaagcgtggcggtaaggtatggattaagattttccctcacaagtcctacactgaaaaaggtgtcggtgtccggatgggtaatgggaaaggtactcctgcaggttgggtagcaccagttaaacgtaacaagattatgtttgaagttgctggtgttccagaagaagttgcacgcgaagctttacgcttggctggaactaaattacctgttaaaactaagattgttaagcgtgaggaagtaggtggcgaatcagatgaaggctaaggaaattaaagcattgtccactactgaaatgctcgaaaaagaaaagtcttacaaagacgaacttttcaacttgcgttttcaattggccactggtcagcttgaaaacaccgctcgtttaaaacaagttcgtaagaacattgcgcgtattaaaactgcgttgcgtgaacaagagttaaacaagtagagtataaaggaggcaatcacgaatgagtgaagatactcgtaatagccgtaaggttatccaaggacgcgttgtttctgacaagatggacaaaaccattgttgttattgtcgaaacttacaagaaccatccggtatacggcaaacgtgttcgttattcaaagaaattcaaggctcatgatgaaaagaatgaagccaaaactggcgatatcgtcaagatcatggaaactcgtcctctatcagctactaagcgtttccgcttaattgaagttgttcaaaaagctgttattatctagattattagctgaataaaattacatgaagggaggacacttactgtgatccaacaagaaagtcgtttaaaagttgctgacaactccggtgcccgtgaaatccttactattaaggtattaggtggctctggtcgtaaaactgctaacattggtgatgtcattgttgctacggttaaacaagcaacacccggtggtgttgtcaaagctcatgatgtcgttaaagctgtgatcgtccggactaagtctggtgttcaccgtgctgacggttcatacatcaagtttgatgaaaatgctgcagttattattcgtgatgacaagactccacaaggtactcgtatctttggacctgtcgctcgtgaattacgtgataaggacttcatgcgtattgtttcattagcgccagaagtactctagtcacacaccgtaaataaggaggtgcgcaacctaatgttgattaaaactggtgataaagttcgagtaatcagcggtaaggatcgtggtcaagaaggtactgttaaaaaggttatctctgccaagaaccggatcgttgttgaaggtgttaacaagatcaagaaacaccaaaaaccaacgaacgttaacccacaaggcggtatcgtggacatcgaagcaccaatcgatgcttctaacgttatgtaccttgacccatcaaccaacgaacctacacgtttaggtgttcgtcgtgaagatggcaagcgtgtccgttacgctaaaaagtctggtaaagacttagaaaactaagactgactgaaaggaggaagcaagtttcatggaaaaccgtttaaaagctcaatatgaaaaagaaatcgttccagcattagttgacaagttcaattacacttcagtaatgcaagtgcctaagctggctaagatcgttttgaacatgggtgttggtgatgcagttaccaacgctaaaaacttagacgaagcagttgaagaattaactttgatctccggtcaaaaaccattggttacccgggcaaagaaatctatcgctggtttccgtcttcgtgaaggtatggcaattggtgccaaggttgacttacgtggcgaacgtatgtatgacttcttggacaagttgatcaatgtttcattaccacgtgttcgtgacttccatggtgtaagtactcgttcatttgatggtcgcggtaactacacattgggtgtccgtgaacaattgatcttcccagaaatcaactatgataatgttaaccgtgttcgcggtttagacattgtaatcgttacgacagctgatagtgatgaagaatcacgtgagttgttaactcaatttggcatgccatttgctaaataaccgaagggggttaatcgaagttggctaaaaaatcacaaattgctaaacaaaagcgcggtgctaagtttaacgtacaaaactacacccgttgtgaacgttgtggtcgtccacattcagtttaccgtaaattccacttgtgccgtatctgcttacgcgacctggcccacaaaggtcaaatccctggtatgaaaaaggccagctggtaaaaacaaacccaagttaaaggaggttaaactttcatgatgactgatccaatcgcagatttcttgactcgtatccgtaacgctaacatggtacgccacgattcactagaagttcctgcatcaaaaatcaaacgcaacattgctgaaattttaaagaatgaaggttttgttcgcgacgttgaatacatcgatgatgacaaacagggcatcatccgcgtcttcttgaagtatggtaaggacaacgaacgtgtaatcagtggcttgaagcgtatttcaaagccagggttacgttcatacgtcaaggctgatgctgttcctaaggttttaaacggtttagggattgctatcatctcaacttcagaaggtgtcattactgataaagaagctcgcgccaagaagcttggcggcgaagtattagcttacgtttggtaatcattaattaagacgggaggtgcaagtaagtgagtcgtattggttataaagtaattgaactacctgctggggtagaagtatcacaagctggtgaagtcgttacggttaagggtcctaagggtactttaacgcggaacatcgccagtgatattacgatgacggttgaaggcaacgaagttaaattcactcgtccatctgatgactacaagatgaaggcattacacggtactacccgtgcaaatgttaacaacatggttgaaggggttactaaaggctttactaagaaccttcaattggtcggtgttggttaccgtgcccaattgcaaggcaagaagttagtattaagcgttggttactcacaccctgttgaattcgcaacgcctgaaaacttgactgttgaagttcctgataacacgcatatcaatatttctggtattggtaagcaagctgttggtgactttgctgccgaagttcgggccgttcgttcacctgaaccttacaaaggtaaagggattcgttacgtcgatgaatatgttcgtcgtaaggaaggtaagactggtaaataatgcagcgtaaagctgtccatactaatatatagaggtgactattgtgatttccaaaccagataaaaacaaaacacgtcaacgtcgtcacgcacgtgttcgcggtaagatttctgggactgctgagcgcccacgcttaaatgtttatcgttcaaacaaaaacatctacgctcaagttattgatgatgtagagggtgtaacgctcgcaagtgcctcaactttagatagcgaagttaaaggtaacaacaagactgaaaaggctgcatctgtcggtgaagttgttgctaagcgtgctgctgaaaagaaaatcgttgacgtcgttttcgatcgtggcggttacttatatcatggtcgggttcaagctttggctgaagccgctcgtgaaaacggacttaaattctaacaaaggaggaataataccatatgactttcattgatccatcaaaattagatcttgacgataatgttgttgccattaaccggattaccaaagttgttaaaggtggtcgtcgcctacgttttgctgcattagtaatcgttggggaccacaagggacacgttggtttcggtactggtaaggctcaagaagttccagaagcaattcggaaagcttccgaagctgctaaaaagaacttgatcactgtaccaatggttggtaccaccattcctcatgaagcacttggtgtttacggtggtggccgcatcatgcttaagccagccgttgaaggttctggtgttgccgctggtggcgccgttcgtgccgtcatggaattagccggtgtggatgatgttactagtaaacgattaggctcaaacacccccgttaacgttgttcgtgcaacgttcgaaggcttaaagagcttaaagactgctgaacaagtcgctgctttacgtggcgtttcagccgaacatttagctgaatagggaggacaaacaacatggctcaattaaagatcactttagtacgcagtgctgctcaccgtcttcctaagcaacgtaaaatcgttaaggaattaggtttgggtcggattaatagttccgttgttaaacctgatgacgcagcaactcgcggtcaaattttccacatcgcacatttagtcgatgtcgaaatcatcaagtaattcaaattttcaaagaggaggtgcctactaaatgaagttacatgaattaacacctagtgaaggttcacgtttttcacgtcgtcgaattggtcgtggtgactcaagtggccaaggtaagacttctggtcgtggccaaaaaggtcaaaaggcgcgtggtaaagttcgtgtcggtttcgaaggtggccaaatgccattgtaccgtcggattcctaagcgtggatttactaacattaaccgtaaagaatatgcggttgttaaccttgacggcttaaaccgttttgatgatggtgccgaagttacaccagaatcattaaaggaagctggcttagttaagaagagttctgctgttaaagttcttggtaatggtaaactcaacaaaaagttaacagttaaggcaagcaagttctctgcaacggcggttgcagccattgaagctgctggcggtaaaactgaggtgatctaatttgctgactaccatgaagaacgctctcaaagttaaggatattcggaataaacttctgttcacgttgggcgttttgattgtatttcgtcttggctcttatatcacagttcctggagttaatgcacaggcacttcagtcggtggcatcttcagggctgataagtatgttgaatacattcagtggtggcggtttaacaaattattccatccttgctatgggggtatccccttacattactgcacaaatcatcgttcaattgttacaaatggacattgttcctaagtttgttgaatggggcaaacaaggtgaagttggtcgacgcaagcttaatcaagcgacccgttggttaacgatcgtcttggcctttgttcagtcgattgggattacggctggttttaactctttgagtcaactcaagctcgttaacaatccaagtatttcgacttacctgaccattggggtgatcctcactggtggggcaatgttgacgacttggatgggtgatatgattacggatcgaggaatcggtaatggggtttccattattatcttcgccgggatcattgcccgtatgccaacatcgatttatcaaatttatcaagaacagttcgttaatgtttcacagagcgactggtggaagagtggcttgtttgttgttgggttagccttgcttgtgctgatcatcgttatgtttgtaacgtgggtcgaacaagctaatgaccgaattccaattcaatacactcgtcgtgcagctggtgcacctgacagtagttacctaccattaaaggtgaacgttgccggggttattcctgttattttcgcgagttccttcattgcaacgccccaaacgattttgctaggattccaatccagtcatggtgacgaaacctggtataccgttttgagtaatatcttcaatatgcagtcgacgactggtgctattctttacaccattctgatcgtgctcttcacgttcttctatgcgtttgttcaggtcaatcctgaaaagctctctaagaacttacaaaagcaaggcagctatattcctggtgtttggccaggtaaggatactcaagattgggtttcaaaattgttaatgcgactaagtacggtcggtgccctctaccttgggttgatttccttgattccattattagcttctgatatttggggtctcgatgaatcaatcggtttaggtgggacgagtttactaatcgttgttggggttgcccttgaaacaattcgtcaaattaaaggattgatgatgaaacgtgactatgtcggtttcattcgttaatcagcgaatgtgttggggagactcaacacatttgtgcattcaggaggaaaaaacatgtcaacaatgaacctgattttaatgggattaccgggtgccggtaagggtactcaagcacagaagattcttgaagattttgatattccacatatctcgaccggagatatcttccgtgcagccattaagaacgaaacgaagatgggtttggaagccaagaagtatattgatgcaggtaacttagtaccagacgaagtcactaacggcatcgtccgtgatcggttagctgaagcggatactaaaaatggtttcctattagatggttacccacgtaacatcgatcaagctcatgctttgaaacaaatcggtgaagaactcaataagccacttgatggggtcatcaacattcatgttgaacccgcagtacttgttgaacgactttccggtcggtttatctgccggacttgcggtgcaacttaccataagttgtacaacaagcctaaggtagaaggaacctgtgatgtgtgtggcggtcatgatttctatcaacgtgatgatgacaagccagcaaccgttaagaatcggttagacgtgaacattaagttgaacacgccattaattgattattacggtcaagaaaagttactctacaatgtcgacggtgatcgcgacattgatgatgtctacaaagatatcaagaaaattcttgataacctgtaaaccaggttccttcagcagcgacgtttgcttttcaaaggtcgttgtgataaaattattcaggtttagccgttgactgatttaatatttttttaatgttatgattagacaatgactggttcagtaatggaccaaatacgtggtagcacggaatctgataataaggagggacagtacttggcaaaggaagacgtcatcgaaattcaaggaaccattaaagaaacgttgccgaacgcaatgtttaaggttgaacttgaaaacggcgctgaaatcttggcacacgtatcaggtaagattcggatgcattacattcgaattctgcctggtgacaaggttacagttgaaatgtcaccttatgatttaactaagggccggattacctaccgtttcaagtaggctcggtctacgtaccttataggaggtaaaaaactcatgaaagtaagaccatctgtaaagccaatgtgcgaacactgcaaagttattcgtcgtaaaggccgcgtgatgattatctgctctgctaatccaaagcataagcaacgccaaggtaaataatttaattaagttggaggtgaaatattaatggctcgtattgaagggattgacttaccacgtgacaagcgtattgtcattggtttgacttatatctacggtatcggtaacacttctgcacagaagatccttgctgaagccggcgtttcagaagacgttcgtgtacgtgatttaactcctgaccaggaagacaaaatccgtgccgttgtcgatggctacaaaactgaaggtgacttacgtcgtgaagtcagcttaaacatcaagttattgcaagaaatcggttcataccgtggcatgcgtcatcgtcgtggtttaccagttcgtggtcaacacacgaagaacaatgctcgtactcgtaagggtaaaaaggtcagcatcgctggacgtaaaaaataataataaaggaggttttcgaattttatggcaactagaaagacaacccgtcgtcgtcgggtaaagaagaacattgaatctggtgtggctcacatccattcaacgttcaacaacacacttgttatgatcactgatatgcaagggaacgccattgcatggtcatcagctggttcattaggtttcaaaggtagtcgtaagtcaacaccttttgctgctcaaatggctgcagaagctgctgctaaggcatcaatggaacatggtatgaagactgttgaagtcgctgttaagggtcctggttcaggccgtgaagccgctatccgtgctttacaagctactggtttggaagttagcgcaattcgcgatgttacgccagtgcctcacaatggttctcgtcctccaaagcgtcgtcgtgtttaatctgtgacgttcattttgagggcaaacttcattttgtacgcacaactactaaacaccacgcgttttgaaaggggtaaaagataagaatgattgaatttgaaaaacctaacattcataaaattgatgaaaacgacaactatggtaagtttgttgtagaaccgcttgaacgcggttatggtacaactttagggaattcacttcgtcggattcttctttcttctttacctggcgctgctgttactagtattcaaattgatggtgttcttcatgaattttcaacgattgagggcgtaacggaagacgttacagcaattatcttgaatgttaagaagattgcacttaagttggaatcagacgaaaccaagacgttggaaatcgacgttaagggtcctgctaacgttactgccggtgatatcattggcgatgcggacgtagaagtcttgaatccagacttaccaatttgtaccgtagcagacggggcacacttccatatgcgtatgaccgcaaatactggtcgtggttatgtttccgctgaggataacaaacatcgtgaagatgacatgccaattggcgttttagctgttgattcattgtattctccaatcgaacgtgtcaactatcaagttgaaaacacgcgggttggtcaacgtgatgatttcgataagttaaccttagacgtttggacaaatggttcaatcactccaagtgaagccattagtctatcagccaaaatcctgactgatcacctttcaatcttcgtaaatctcaccgatgaagctaaaaacactgacgtgatggtcgagaaggaagaaacgcataaggaaaagatgttagaaatgacgattgaagagttagatctctccgtccgttcatacaattgcttgaagcgtgctggcatcaacacggtccaagaattaactaacaaaactgaagctgatatgatgaaggttcgcaaccttggacgcaagtcactcgaggaagttaaggcaaaattagctgaccttgggttatcattacgcaaagaagactaatacaagggaggatatccgttcatgagttaccgtaaattacaacgtacaagttcacaacgtcgtgccttattacgcgatttgacaacgtcattgatcgttaacggcaagatcgaaacgaccgaagcccgtgctaaggaagttcgttcaactgctgacaaaatgatctctttggccaagaagggtgatttaagcgcccgtcggaaggctgccgcattcatgcgggacgtcgttgccgatgttaaggaagatggcgacaacgtggctgtacaaactgcattgcaaaagctatttagtgacttaggtcctcaatatgctgaccgcaatggtggttacacacgaatttacaagactatgcctcgtcgtggcgacggtgcacaaatggttgtcttggaactcgttgactagttaagattgttttacggatcactgggactgatgattgacgggcgttatgatggtggctactggcaaaatagtagctaagtctagttcggaagttatttatggttagacatagatggcatatcgcagttctaagtgattttttttggtgctagttacgagcaaccgctgatttagggattgattccctaaatcagcggttttttgttggaatggataggtgtttttaatactcgtgatgacaacggtttgttatttgcagattatgacctgttgaatcgggaaagtggatatagtggtctcaggtactgactgtgaagatgaagcacatgggcgtttagctgtgtctgggcgacaaaaaaggtatcaaacaggatgcttgataccttagtcgattgattactagttaattatgccggtccaacagccgtttggttagactaatcagatccgtcttcgcaggctggtctggaagtttacgcatgattgccagcgcgtcttgagtgtacttggtagcgagttcttgggcttgcaccacaccgccggcattgatgacaagtcgttgtacttcctggcgctgagtgtccgaaattgccccctgtagtcgcatcagcggcaataaatcgtgcttagcttctgtctgtaaggcaaaaatcaacggcgaggtgtagacaccttcagcaacgtcttcgaggatgggtttgcccgtttcctgactgacttcttgatagtctaaaatatcgtcaagaatttggaaggccatcccaattgcgagacctgctttacgagcgcgctgggcgaaatgactactttgaccagattcataagcacctagaaaacaactcagtgcgaataactcggcggtcttaccttgaatttgttgcaagtattctgccatggtaatgtcaaggtggtagtggcggtccttttgttggacctcgcccactagaatcttttccatgttctcagagttcatctggatgcttttgaaactgcttgaatagtgcgctagaatcttgaataccacaacgaataggtagtcgcccgcatacacagcagtatctttaccaaaacgttcttgaatcgtgacatggtgccgacgtagtgcagcatcgtcaacaatgtcatcatggatcagcgtagcggtatggagcgtttctaatgacgccgctaaggccaccatccgttgccgatcagttgttgtaaattgtgagaataggaggcagtatgccgggcgtaagagcttaccaccaccatgaatcatttctaaaatcgcgtcattgatgtcggcatcttgaatattgatgttcgccgtcatcagctgcatcacttgttgcagctccggttgtagtgccgggtaatcacgccaaattgggtgtaattgtgttgccgattgcatatgggttactcctttgtttgatctggatggtgttctcgattgaatttgagatagcgtaagatcgtgacgtgggtgaacaagtagttggcggcgattccgagagcacttcccgctgctagtccaataatcgaaagcactggcaagtagagcatgaccgtccacgtctgtgcaataagactcgcgaccaatagctgaccaacattatgcatgacgccaccagttgctgaaattccaataatactaacgcgtttaggccctaattgtttgaccaacagcatggcaaacaggctgagaaaggcgcccccaaaactatacagaaaggttgataaagtgccacctaggagggccgttaaaatcaaacggagccaggttagggttatcacgtcagttaatgataatgtatagattgcaacaatggtaatcagattggctaaaccaagcttggcacctggggcaaaggcaaacgggaatggaatcatccgttcaaggatgccgatgatcacgccttgtgcaaccagtaacgcgatataaatattacgatgagttttgtttgatcgttcaaatgaattattcatattctactccgtaactaaaccattaccgccagatttgacttgaccgttgctggccttaatttcaaccaagagtttgtggggcaaacaaacaatcgtttgaccaggtttatgaatccagcctcggcggacacatacttggtcagaacagttggctttcgtaatcgcaacgcgcttaggtttaaatgtgatcgtgttgtagtgcccatggttatcgcgataggtgaagtgcttagtcgttttcagattcgtaatattgacacgcttcaagacggtcccattatgtgagaccacggcgttatacgtggtttcactgctcgtggcctttcgcttagccactagtgccgcatgttcagcttgttgtttttgctggtatgaaaaaatcgctagtggggtgaacgataaaataattagcgcaacaataataataatatcaaacggcttgatcatatccccataacgtttgaatgtccggatcattgtccgtaatttacgcatcgttaaccctccaattcaatgaaataaaaaatggttcaaggggggaaaaacaacccttgaaccatcgggaaaggatttaattaattataacgcatctagcgggttttaacaccgtcgtaatgagaacgaacgttgccgtaccaccagtgtccaaggtgtttttgcatccacggaacgacccagtagtctaacccaaatgtccgtccggaaccgttcattaaggcgagggcaacaaagatcatccaaatgttgacccagtagaacatgccagataagcagaagacgacaactaagccaatggtgactgcgttagcaaaccaagtaaagagtccgaagaaaatacataatgcaatgacgatttcaacacaagtcatgaatttctggaaaaagagggccatttgcatgttcggaatgaagaccttggtaattgattcgaaccaatgtggcattttgtcaaagaccatcaggggttctttaccgtacatgtatgaaagactgaagacacccttagcggctttagcggttgacgtggcagcttcagaagcaccactggttgcagcggctttagttgcttgagaggcaccactggttgcggccacggtaatccattcgaatggtaaccgtaacttgtcagtgaaccaggattcagatccctgaactttagtccagcagtcccataaccacatggcaccatagaagaaccgcagtggcacactccagagtacgttaccagcccgtgagacccaaccgcggaagacgttacggttattacgagtccggaagaattcgtgcatgaagtactggaataggtagtaacctgagaaaatctgaacgtagtacatccagttgatggcgtgttttaaaagcacggcaataaaaccagagacgttccacttctctaaaacttgtgcaacggcatatttggaaccaattgagtcgacggatgcttgataagcgcccttaaatggcttgatcgtaacgtcagtctggtcaacgttcttaataataccttcgacggccttagctgcggtttcttcagccccttgaacgatttgtgggactggccgtggttggtcaggttcttggtagctggttgaatcaccggctaagaagatattgttacaatccttagcttgcatgaattcattggccatcaagcgaccaccgcgggggttagtttcaatgccgaactttttaacgatactattagcacgaacaccggctgtccagattaacgtgtaggttggaattggatccttgccttttaagttaacatggtcttcacagacttcggtaatcatggagttcgtcatgattttgacaccatgtttttccatgtacttagcggccttaccggcttgcgtccggttgagcatgttaataatagtcggcgctgcttcgaccaattggagcgtgatttcacttggatcgagcttgttgtctcgagccaaaacatcacgatattcgattaattcaccaatcagttcagaaccagtaaaaccagaaccacagactgtaaaggtcaacatggctttgcgcttagcagggtcgagctccgccgccccccgccgaataattgcagataagtgagcacgcaatgccatcgcttgttcgaaggaccacaattcgaagccgtgttccttaacaccgggagtcccaaagtcattggattccccacccaaactaattaaaagttgatcatattgataacttccgtgttcggtagtaactgtttgtgcctttttgtcgatgcccgtcacggtatcggtcacgagacgaacgttttttcgccgtgcgaacaaccgttgcaaatcatattggatatgctcaggttccacccgttcggtagcaacttcatgtaattcagtcatatacgtgaagtatgaatgccggtcaatcaacgtaatctcgacgtctgcattttttttgaaatgcttagacagtttcttggttgcgtaaacaccagcaaaccccgcaccgacaacgacaatatttttctttgccattgcgtaacaactcccttgaataatagtgtaaaaagataattccactaataattataacgataatgtaagcggttgtctatggattatgggaaagaatgcataaactatcacattatctaagccgcgaaaatagtggcatcgaggtttgaacggaaaacgttgtcaataccgctattattaggctaaaatatcatttttttaatggaatgggattgactattaccagtttaaacgttaagattaatgtgaattttcatacaaaaaggttaggagtgggatatcatgaaattcaaatcagttattacgggtgcttcagttgttgcaatttcagctttagctttagcaggttgtggcagcagttcttcaagttctagctcgagttcatccaagaagagttcatcttcaagctcatcagctaagacaactaaggttgctaaattaaccgctggcagcaaaatgaaagcgggtacttataaccttgaagaagaaaattattcacatggttatcggaccaagatgagtatcacagttaataacaacggtaaaatcactaagtccagttatgaccaagtgaacaagaacggcaagtccaaagttgatgatacttcatataacaaacaaatgaagaagatcgctgggactaaccccaagacttacatgcctaagttaaacaagacgctgacgggctctgccgctactggtaacgtgggctccattgatgttgtgactggtgcgactgaatcatcaaagaccttccaaaactacacacaacaattagttcaagctgcccaagcgggtaacaagtcgaccattaagattgacaatggtgccaagatgaaagatggtacctacaagttgaacgaaaagaactactcacacggttacaaagttactttcgcaatcacggtcaaggataataagattacgaagtctgaatataaccaagtgaacaagaatggcaagtccaaagttgacgatgcagcttacaacaagcaaatgaagaaggttgctaagactaaccctaagacttatcaaccagctttgaacaagtcattagttaagagtagtgatccaactaaggttgacgttgtcacgggtgccactgaatcttctaacacctttattatgtacgcggaacaattacaaaacgcggcacaaaagggtgacaccaacacgattactgttgacaacatgattttctctgaataagcaatttaattattagattcttttgaggcctgaggcgcatgctgagggccttttgtttttaattgaacaaccacaaaagtttgtcactcagttgggcacaactttgagcaagctaaatccatacatggatattggtttaaaaaataatagtggcggtgaatgttaagtgcaaaatggctgtggtagtacaaacccgaccgtcgagttgtaccgtttgctgtaggtgcgctgatgtcagactagcgtagaaaagcttggatgacgcgcaaacagtctcaccggatgaatcaagactttggtataatgacaattgaaattaaaaataggggaagtattggaatgaagctaaaaaaatgggttcgaattggattaattgttgcaatgatcgtgccattgacggcgtgtgggacgagtacgagtcgcaaaaatgctgctagtagccgccccaaaccaactaaggtcgtcaagacgccgatcgaggatacccagttcatgatgggcacagttgtcacgttgcggatttataataagggtaaggataacgtgttagctggggcgtttaagctgttgaaaacggaagctaaggaaattacggtcaatcaaaaaggatctgaaattgataagatcaacgccgctgccggtaaaaagccagtggctgtcagcaaggatatctacccaatgatcaaagcagcttactattatagtaagaattcagacgaatcctttgatttagccattggtccgatcacatcactctggcatattggattttccgatgccaaggtgcccactcaacaagaaattgataagaacgttaagctggtagactacaaaaaagttaaattaaatgacaagaaacggaccgtttatctagaagaaaagggaatgcaactagaccttggtgggattgccaagggttacatgaccgatcaagtgaagacgtacttattaaatcatggggtttcaacggccattattgacctcggtggtaatatttatgttctgggtgacagccctaaaggaacgaagtcaggtaactggacagtcggtatccaagatccaaaagcgtcacggggtacggccattggctcactacctgctaagaataagtcaatcgttacttctgggatctatgaacgctatttgaagaagaatggtaaagtttacagtcatttgatggacccacaaacaggggcaccttatcaaaacaatttgatgggcgtttccatcatctcgaagaagtcggtggatggcgatgcactatcgacggccacctttgacaaaggcctcaaaggcgggatgaagtacattaatggtaaagcggatcaaggtattggggccatttttattaccaaggataaaaaagtatacgtctccaataacttgaagaagcagttcacgctgtttggcgatgctggttacaaatgcgggccagccactgatttaaagtaagattggacgtgaagttcagttactacaagttccgtcagatatgttatgataataaccatgaattttaaggaaatgagggacaatggtgagtccgattattgacgttaaacatttagattatcgttacccgcaacaagctacggatcagttaacgttacacgatatttcatttacggtcatgccgggtgaatgggtcgccattgtcggccataacggttctggtaagtcgaccttggccaagaatttaaacggactgttagcaccagcggccggaacgattacggttgatggtcaagtattatctgaagaaaccgtttgggacattcggcgcaaaattgggatggttttccaaaacccagataaccaattcgttggggcaaccgttgccgatgatgttgcgtttagccttgaaaaccagggcgttccgcgtcctgagatgctaacgcgggtacaggcggctctagaacaagtcaacatgcaggattttgcgacacgtgaaccggcacgtttgtcaggtggtcaaaaacaacgggtggcgctggctggtatgatagcggcgcggcctcagattttgattctggacgaagcgacgtcaatgttggatccccgtggtcgtcaggaagtattgacgacgattcgcgatatgaaggctaattcagcgttaacggtcttgtcaattacgcatgatattgacgaagcggccagcgctaatcgggtcttagtgatcaatgacggtgaggttaaggaagaggggaccccagcggaaatttttcagcatggagaagccttaattaagatgggattggacatgccatatgctgagcgcttaaaagcagcgctaaagcggcagggtgttcaagtgcccacacaatatttaacagagaaaggaatggcggactggttatggcaattacgttcaaacaagtagattttacttaccaaccgggtacgccgttcgaaactaaggcgttaactgatattaacgtcaccattcccaccggctcttatacggctttgattggtcatacggggagtggtaagtctacacttttacagcatttgaacgccttactcaaaccgactagtggaacggtcacgattggtgaacgggtcattacgccaacgacgagtaataaggacttgaagcgattgcggcaacacgtgggcatcgtctttcagtttccagaaagtcagttgtttgaagaaacggtggccaaagacattgcgttcgggccccagaactttggggctagcgaagcggatgctttgaaaactgcggctgaaatgttggctttagttgggttagacgagtcgttactgacgcggtcaccgtttgacctctctggtggacagatgcggcgagtggccattgcgggagtccttgcgatgcagccgcaagtcctagtcttggatgaaccgactgccggattggaccctcagggccgtttagatatgatggagatgtttgcccgtttgcgtcatgaacgtgatttgaccgtggtactagtgacccatcagatggatgatgtcgccaattacgcggataatgtaatcgtgatggatcgtggacaaatcgtcaaaacggggacgcctcgtgagatcttcaaagatcctgcgtggctaactgcccatcaactgggcttaccgaaaacaacggcctttgcgcatacactccaaaagcaaggctggcaatttgatgagtggccgttgaccgaggacgaattagcagcagccatcgtccaacagttgccaccgaacgcgatgggggaggtggccgctcatgatgaataaattgatttttggtcgctacattccgggagactccgtggttcaccatatggacccccgggcgaaactgttattgagtttttattttattgggattatttttattgccaataactgggcgacctatgccttgctatttgcctttacattggccgctatttacctatccggtgtgaaatggtcgttcttcatcaacggcgtcaaaccgctgatttggttgatcttattcaccgtcatcctgcaagtgttgtttagtgcaagtggcgggcacgtttactttcaatggggcatcattacaatcagccaacttggattgatcaacggggtctatattttttgccggttcgtgttgattatttttatgtcaacgctgttaactctaacaacgccgccactggaattgtcggatgccatcgagtatatcttgatgccgctcaaagcggtccgttttccagtctatgaagtggcactgatgttgtcgattgccttacgctttgtgccaacgttgatggacgaaacggaaaaaattatgaatgcacaacgggcccggggggtcgactttggtgagggcaatatctttcaacaaatgcgtgccgtggttccgctgctgattccactgtttgtcagctcattcaaccgggctgaggatttagcaacggcaatggaagcacgtggctatcaaggcggcgagggtcgcagtaagtaccggattcttaagtggcaccaacgtgatacgtgggctaccggatgctttgcgatcttgaccgttgcattgattttcttgcgtgcataaatgaagactgattaacgtgggcgtcgcactgatggcgacccacgtttttaactggagggatattgtgaccacgcggtataaagtagttttagcatatgacggcaccaattttgcgggttttcaacgccagccacaccagcgaactgtcgagcaggtcgtcactaaggcggtcaataagatggcgaaagatcccgttgaaccgattgtgatctacggcgcgggccgaacagatgctggtgtacatgcgtttggacagacgttgcattttgacttgccgtacgaaattaatccagaaggggttcggcgcggcctgaacagcatgttaccgatggatacaatcgtaaaggccgtttccattgtgccgaatgattttcacgcgcgttatgatacggtcggtaagcggtactggtatcgggcctatcaaaatgaatttgtagatccatttaaacggcactatacggggcattttaagttcgctgcggatattgacagaattcagcaagccatcggtgacttagaaggacggcacgatttctcgaccttcgttgcgtccggttcgcaagcacatgaccatgttcgtgagatctattcagccaaagcgtgggccttgccggatgaacgcgaaattcagtttgaattttgcggtagtggttttttatataaccaggttcgaatcatggtggctgttttgatggaaattggtcagggccggcgcgcagttgactgtattccagcattactagcggctaaagaccgtgagcaagcgcggggaacggctcctgcggctggactttatatgaaaaaagtgtattatgaacaaaatgaattacaagctgatttgataaagtattgacttctgaggcgaaattgggtagactagtcgttggtattgtttgccccacgataagccccggaaatcttattgagtgtcaaacaaacacagaaaatggaggaacacaacgtgcgtacaacatatatggctaaaccaggtgaaattgatcgtaaatggtatgtagttgatgcaaccgatgtacctttgggtcgtctttcaactgtcgtcgcatcaatcttgcgtggtaagaacaaacctacctttacccctaacgtggatactggtgataacgttatcgttattaatgcaagcaaggtcgctttaactgggaagaaagcagaacggaagatttattatcatcatactgcttatgctggtggtttaaaggaacggactgccggtgacttcttggcaaaggaacctactaaattgattgaaacttcagttaagggtatgcttcctcacaactctttaggccacaagatgggcttgaagttgcatgtttatgctggtgcagaacatacgcaacaagcacaaaagcctgaagttttggacatcactaacttaatctaaggaggaaactacattggctcaagtacaatatcgcggcacaggccgtcgtaaagattcagtagcccgcgtacgcttagtaccaggtactggtaaaattgttatgaatgacaaatctgttgaagattacattccatttgcagatattcgcaaggaattgttacaaccattcgaagtaactgaaacaactgatcaatatgatgttttagttaacgttaatggtggtggcttccatggtcaagccggcgcaactcgtcatgggatcgctcgggcattgctcgaagttgacccagatttccgtactcctttgaagcgcgcgggtctcttaactcgtgatgctcgtatgaaggaacgtaagaagccaggtttgaagaaagcccggaaagcttcacaattctcaaaacgttaatattatccaaaaacgttgttttatcaacattttctggctatatgagaaagcacctgtctatggacgggtgctttttttgcgtgtgaacagaaaaataacacaaaactaaaacatggtaggactcatgatataaaatagactactttgttagcgtcctggctggcagcacgtgttcatgtcagtacgacttccggggtgagcgactatgcagttagcccgccttgaaacaagctaagcaagtaacgctcggttacttaaaaatggattgggccattgacggctcaatccattttaattactgacgtttagttttaccaaaagagaagacggcaacgcaaccgaggccggtatggctagtgatagtcggcccaatgtgttcgagtaaaatttcagcatcaggaaccttggctaaaatcttttcacgaacggtttgggcggcttcctgagcgtcgctagtggcaatgataatgcgcggcttggtctgatcacgtaaatcggctagtgtgttgttaactagtgtggtcagtgaccggcgccgtgagcgcaccttttgtactggacgcaagtggccgagtggatcgacgtccatgactggcttgatctgtaagagtgatccaaccgtcgcggaggtccgtgagacccggccgccgtgataaaggtaatttaagtcatcaacggtgaaccattggtgataatagaggcggttttcagtcagccaatccgccaattgggcgattggcataccagcatcgcgcttgtcaatggcatctagtagcatcaggccttcaccgcagcaggctgctcgggaatccacgaggtagatctcggcatctggctggtcttgtaaaagcatggtcttggcctgttgcgcattattgaaggtcccacttaagcctgatgaaaagccgaggtataggattggcgtatgtgcctgaacgtacggcttgaaaaattcaataaactggccgatattaatctgagcggtagaaggcatcacaccgttaccaatccgatgataaaagtcagtcaagtcaaagtggtgacccaaatcgtccgcgtattcctggtcgtcaatcgtgacgttcattgaaacaaaatcgacatgcttgtccttaagtagttgataaggtaaatcaacggttgaatctgttaatagctgatacatagctttctcccttaattgtacttactgttacattgtacgcttatttgggcggccatggaaaattaatacatgctgtatttttacatacagcagtaatttacggtaacaactagttggttgtcgcaatcctggtagcagcgtgaatgctgatcaagaaattgaactgggcatgtcagtaaatactggacgcatcggaaggtcagttatgggttaactgcaataatggcgtagtgactaggaccgtgcttttcagtcatggtgatgaggttcgacgactaatttgcctattcaatgaggcgctgtaagttgattgaaatcagccgatcaatggcgtgattttgctgctggcggtagggggtggccccggtttcataaaggagttgcgcctggtgatgatgaacgctgatctgttcgagttgcggaggcaatcgaagaatcgcgataccggtggtcagttggtgctgttgaattaattggctgcgcttgaatagcagtaagtgtgaggcgctggggccgtatgactgtgataacaagacgtagtggtcatagaaggccattccttgaatattgggtgggagcttgccgtgccagtcactaactgcctttggtaaaatggcgtgactcgtggtcattctgtatggcgtgccggcgctcgtcagtggatagcgggcaaccaaggtggtctgtccaggtttgaactggccgacataaagggcctgatggtgataggtcagtagtgaggcattgctcagtgttggcagtgaccagcgttgctgatagtgaacggcaatggaagtggtcgggtcgaagtgccgtaatgcggccagactaacgctcacgatagccccatgaccgtggcgatgactgcacaaccaaatccgctggtggtgagggtcataagctagaccacccacatgtggtttaccatgcaataagacagtgttgcataattgatgtcggaaacgatcctgtacatataggacagattgggttcgaccagtggcatcgtaagcggtggttagacgataacgaccggcaataacaacgccctgtggaatcatcattgtcgtcgtcgtgagttgtttagtgacgaggtccctagtcagggtggcttgtagtcccggctgaatggtggtgccttgcaacataccgattgggtcgaattttgctagtttaaccagatccggatactgacggatggtttgataaaattcggttggtgaaaaaacagcttgggtggctgttctttgaagggtggttggtgggtacggtagtgtcggtcgtacgcgactagctagaccgccgaggggatggccccaaattaacaagcctgtgattagtcctgtataaaaatgataggtataacggtgcatcgcgggtccctcctctagtttaagtgtcttcaatatagcatggaaagacaggccgcttagcggatagtgaaaggttagttaaggaaagaaactgagtggggcataattgaaaaattaacgttttacacatctgtttttaattacatttacataaaacattgaattttctaattaggaatcggataatgaacgtgttcaagctgtttagcaatctgaataaagtgtgatatcccggtgctcgccaagttaggcgagtgctggctgtcaaaaacggaggaaaatataacgatgcgaattagtgcggaaacggaacgacaatttttagaagcagtttttaaggcccaacggtttagtgccaaggatggggcactgctggcagacactctggtcgatgcagatttacgtggaatctcatcacatggtatccagcggctggcttggtatacgcggatgatcaaggatcataccttggaaccgacgaatcaaccgaagattttgaatgaaacacctaccagtctattgatcgatgcgaaccagagcatgggccagattgcgtcggcgtttacgatgaataaactgattgaaaagactaagcaactcggtgtttcattagcggttatccgcaattcgaatcactttggaacggcgggctattattcgcgcatggcttgcaaagcgggtttgatcggtatttcaacgactaatacgcggccgttggtggtgccgacgaatgcgacagaagcttttttgggttccaacgcattagcttttacttttccagccgacccgcatcctttcgtttttgacggcgcgactgcggtggtttcaagcgggaagattcaagtgctggccaaaaaaggtgcacagattccgggtgattgggcggttgatgagcatcgtcaagtcttgcatgatgcgcagacggtggaggataacttggctaaaattgcgttttctgagaatcgtcctggtggtggggtcctgaccctaggtggccagcaggaagtcaattcaaattacaaaggctttggcaactcactaattattgagttactcacgggaattttagcgcaagggtcgctgtcggctgatacgaacaccggtaagcatgactttagtcagttcttcatgacgattaatcccgccttatttggcgatcccgaggtgttgaaggccaacgtgacgactatgtttgaccgtattcggcatttgaagcatctaccaggtactaagatcatgataccaggtgaccgggaataccggcactatgatgaaaatttggtgcagggcgtcagtattgatccacagacgttgacggaaatgcagcaagttggtgctgaatttggagtggcagtccccgcagccttgaaagcgtagtttggtgtagttgcggcaattattgtgactaaaatggggatcacataaactgatgatagtgtggctggaatctgctctggatgctggcgacactatttttggttatcacgattatgtgcggtggtgaagaccagctagctggttgggaatagatggcagttcagacaactgacgagcggctaaggttagttgctaaagcatacggaacattgttgaaattgtaatcgaaaatgaccgtttgtcagtcgttcgttgtgagaaatttagcgttggagtgcggcttttagactttaatgatttgccttgcggtggattataagttaagtcagtgcaagctactggctaaaaatattttcagaaagtggcagggaaccattttaatatctgtaaaatgatttgacacgcaaacttgctgatttaccagtatttattagcagttagcgaggatgatgacgactagcaaatcgagggtggaccaacgtgtttttgttgattaatagaaaaagtttgcaaaaaccatttgacaattctattgattagccgtatattttaagtcatcaaatacacattataaattaaggagattttaatcatgacgattaataccaatttacaattgaattcgtattattattactggtttacttagtgccttggcatccactgcgaggcacgccctcgcaacggatgtgaccagtaaattttggaatgattaaaatttatggaaaagtcatatcagtgttgtgaacaaccactgtgtgacttttctgcttctgagtagcggtgtttttcgggcaccctgcgaagaattagtggactcacagttggtgtaactgtgagtcttttttattagccaaaatgagagggagcgaagttaatgcaagcatttgatgaaattgatgaattagcggtgaataatctacgagtactgagtgcggaaatgattgaacgggccggttctggtcatccaggattgccactcggcgcggctccaatgatgtgggtactgtggagccgacaattacgggtcgatccacagcagtctcaatgggctaatcgcgatcgctttgtcttatcagccggacacgggtcggcgttgttgtacagtctgctacatgtgagtggcttcaacgtgacaatgggcgagttacaacgttttcgtcaattcggcagtcacacgccaggccaccctgaactgggaatcgtggatggtgtggaagccacgaccggtccactgggacaggggttagggatggcggtgggcatggccctggctgaacggcaactagcggctcagttctccgagtcaccgcagttggtggatcactatacttatgcgttagtcggtgatggtgatttgatggaaggcgtctcccacgaagccgccagctttgccggtaatcaacaattgcaaaaattaattgtattgtacgacgataacgctgtttcgcttgatggccccaccagccggtcgtttcgtaccgatgtgaaccagcgcttcgctagttatggttgggatacacaaacggtaggtgatggcaatgatttaacggcgattaatgccgccattgagcgtgccaaacacagttcacgtccaagcctgatcgctgttaaaacgacgattggatttggcgcaccacaagcgggtacgaatgcggtgcatggcaatccgttgggaacggccggtttaactagtttgcggcaacaattagggtggcaagccgcgccatttacggtgatgccggccgttgctaaacgcgcacagcaactaatcttgcaacgtggtcagcgtgcacatcgccggtggcagtcacaacgagaggctttaccacaagccgtacaacaccgtttcgaacaacagctcagtatgcgtctgccagttgacttagccaccagtttaccgatctttgatgaaggcgcccaagcttcgcggatcacgagtcataccgtcattcagaagctagccgctcagttaccaggattagtcgggggcgcggctgatttagccagttcgaataaaacgaccattgagcaggatcaattgtcgactccggtgaccccggatcagcgcaacgttgcctttggtgtccgggagtttggtatgggcaccattttgaatgggatgactttacacggtggcttgcgggtctttggtggcaccttccttgtcttttccgattacacgcgtgcggctattcgattggcggcgatgatgaagttaccagtcacttacgttttcacgcatgactcgattgcagtcggcgaggacggtccgactcatcagccaattgaacagctaatgagtttacgattgattccgaatctaacggtgatccggcccgctgacccgaatgaaacggtcgcagcttggtggcaagccatcaacgcgacggatcatccaaccgtgctcgtcttgacccgtcagaatttggcagtgctatccggatctaagactaaggccatgactggtgtggctcgtggcggttatgttctctcaccgcagcgtggccgccagccaatgggaatcttgattgcaagcgggtcagaagttgctttagctcttcaggcccaggcgaaactagctacgttaggtgaagatgtcagtgtcgtttcaatgccgtcgatggaaaactttgcgcgccaatcaacgaattaccaagctcaggtcttgccacctcaaattcggcggcgagttgcagtcgaaatgggcgcaacatctggctgggaacgttacgttgggttagatggggcggtactaggcttggaccactttggcgccagtggagcggccgaccaagtattagccgctaaccagttcacggtagcagacctagtgcggacgtatcaacaaacgcacgtggatcttggtcaacaattgcgagtcatttagaaaggaagttagttaaagcatgattgatggacaaacggcactctttggatttatcgcgcaccccgcgcggcacagtcgctcaccgcgaatgcataatttgagttttgactactgggggctaaatgcgcgctacttggcgtttgatgtggcaccggatggattggctggtacgcttgctggaattcgtagcatgggtatcgcgggggtgaacctttcaatgccattcaaacaaaccgttgtaccgctactagatggtttgacagtgcgagcgcaacggattcaagcggtcaatacgattaagaatgaagctggcaagctgattggtgacagcacggacggcgctggagtttttcaggatctcttacatcaaggtctgaacttggttgataagcacgtcatggttttaggcgcgggaggcgcaggtaaggcaatcattgcggcggctttagattatggtgtcgcgagtgtaacggtctttaaacgcaacaacgaacgctacgccggtgttcagcactggttggagcaactcagtaccacgacttcggtaccactccggctctgtgcctatgaagaccaagtacggatgcagcaagttgctcgtaccagcaatttgatcattaacgcgaccaatatcggcatgacgactgctggaacgccattaccaatctcaattatccagcaattagtcccacaacagacggtctatgatgtgatttaccaaccgctagaaacgacctttttgcgcttagcgcgtcagcaggggtgcgccacatataatggtttggggatgttgatttggcaaggtgccttggcttttgagttttggactggtaagcagatgccagttcaacaggtccgccaagatatgttagccagtattcaagcgactccgccgattacggcgcaggcttaggccttaacttttgagaattgattagtaggaggaaattattatgattattatattaaaaccagcaaccgctacggctatgcaggcaaagttagtgagtcaatttggtgcggatcacgagatcttcacgcacaataatcgaattgcaattcaaggattgcgtccagaagcacttcccgcggatgtgcaagcagccagtgaatcaatcttgacggcagttcccgcagcggtccaaagcagccgtctctttcacccagaagatacgattattaagacgccacacagtgtgattggtggtaatcaattcgtcatgatggctggcccgtgttcagtcgaaagcgctgaacacgtggaccagatggccgcggttgccaagcagggtggtgcggcgattgttcgtggcggagcattcaagccacggacgtcaccttacagcttccaaggcctcggggagacgggactccaatacttacggacggcggctgataaacatggccttgatatgattaccgaagtgatggatgatgaacacgtggcgatggtggcgaaatacacggatatttttcaaattggtgcacgcaatatgcaaaatttctcgttgcttaaagccgttggacagacccaaattccggttgcattaaagcgaggaatgtcggcaacaatcgacgatgtgctcaatgcagctgaatacattgcagctggtggtaatcatcagatcatgcttttggagcggggaattcgaacgtttgataataagtacacacgcaacacgtttgacttaggtgcagtgccagtcttgcaatcgttgacacattacccagtcatcgttgatccgagtcacgcggtcggtacctgggaactcgtgaccccgatggcgatggcaggtgtagcagctggcgccagtggcatgatcgttgaaattcatgaccagccaacgcaagctttatccgatgggccgcaagcgttaaaacccgcgacgtacttaaaaatggcgcaacaggctttccagttacatgacctgatgcaaacgtgggcgtaggatgtgcctatgacaaacattgaagtcaagacgcgagttaaacagtatcagatcaagatcatgattgacagtttacatcatctaggaacgttggtaactaaggtatggtgtgcccgtcaagtagcggtggtaacggataccaatgtgggcccgtactatgcgaagctggtaactgatgaactgacggcggctggattcaaggtgcgtgtgatgacggttccagccggtgaggcgagcaaaagttggtcacaagtccagtcgttaatcgatcagctgagtgccgcccattttagccgcagtgacggtgtcatcgctcttggtggcggggtggttggtgacttagcagggtttgtcgcttcgatttatatgcgcggtattgccttgattcaagtaccgacatcattattagcgcaagtcgatagttcggtgggcggtaagaccgcgattgacttaccaactggcaaaaacttagtgggcagtttttaccaaccagatttagtcgtcattgatccggcaattctggtgacgttaccgccgcggatgctcgcagaaggttatggcgaaatcgttaagtgcgcagcattagttggcggtgatttttggcaatccttgcaacaaattaccagtgtggcagcgattttaccagcagcaccagatttaattgcagctagtgtggcgttcaaagcgcgcgtcgttatggcggatgaacatgaacagggtcagcggcaattattgaattttggtcatacgattggtcacgcagtcgaactattggctgacggtcaactaatgcatggggaagcggtagcgattggtctagtacaggtttgtcggttgtttgcagcacatgggttagcgccgactagtttaacgtcgacgctcaaggcacgcttaatggcggtagggttgcccacggaattaccgccgatagcgccgcaagccgtggccgcagtgatgcaacacgacaaaaaagtgcacggtacagcgctgacctgggtctacttatcggcggttgggcaaccccacctgtatcccatagcggtcacggacttggcgacttggatgggtgacttgtggtcggtgtcgtgattagacgtaagtttacaatatgcttcagttcgacacatgacggttagccgggtgggatctgaaaatttgagggagcatcagaacttttgacgtccaggttctgatggacttacatggtagattaacaatcggctttccaagtaatagttggaaagccgattgttattggctagggcgtgatgtttgtatgatcaagtcgttagtcaggagtaagttcacattgtgcgcgttaattttcatgaagcatgcattaaaatatgccagtcttgagtttaaaaagccagtttagggtcaccggcaaaagttctgatttgcgtaaacttgctcggctagatcgtccttcccccagaaatgggcactcagcccggagtcgggaaatacgtgaatgagtgtctgaacctgtcaaatggtatagttgaaaaacaactagcttaccaatagcctaaaagtttcatccagagtgtgccaccaacgccccatactaatagatagaaaccaccaaggcacagattcagacgccaccattcggactgcgttatgtaacctgatccgaacataatcgaggcgggaccgttggcgtaatgggtggtcgaactgaaaatggcaccgtcaaagcctaatagtagggctgctagcattgggggggcgccggctgaaattgccacacccaagaaggcgccgtacatggcggagacgtgagcagtggcgccggcaaacaggtagtggctgtaaaagtaaacgagcatcaaagctgccaagacccatagccaactgattccttgcagggcctggcccatagtttgtgaaagccatggaataaagccaagactgttcagtttgccagccataaaaataagaattgaaaaccaaacgagtgtgttccaagccccagtttcatgtaataagtcgtcaacggataatacaccggttaataagagcaaagtgacggctatgaaggccactaaggtcgcgtctagcccagtgagactagctgagatccaaagaaagagggccaacataaaaataccgcccatgagtttttcggccaaagtcatggcccccatctgctcaagttcgttggcagcccacgcatgcgcgttgggtgtattcttaatttctggcggatagagccaataaataatagctggaacgctaattaagcaaataagaccaggtaatagagcggcgagtaaccagtccatccatgtgatgtgaatctgcattgcttgggccaaggccacggcaacgagatttggtgccatcgcggtcatgaataagccactggtggcaatattaccatggaaagctgacataatgagaaaactaccaaccttacgctgcgtaccgttttgtgggtcagagccgtatgctttagctaaagattcaataattgggaagacgattccaccggcgcgggcggtattgctaggcgtggccggactagtgacgagatcgacaccaatcagcgcgtaggctaatccaagggtctttttaccaaataatttgacgaagaccagcgcgactcgtcgccctagccccgtttttacgaagcctcgtgataggaagtaagccattgcaatcatccaaaccgtgttatcaccaaagccggccatggcatccgtcatcgaggtaacaccaagtaagacaccaagtgtgagaccaataattgcgacaccggcaataggtaacggctgggtaatgcaaccaatgatagtgccaacaaagagagccagcatgtgccatgctaatagactgagccccgcgggacgaaatggcgcgctcagccaaataatcaaaccaattatcagcggccatgtaagttgctggtagttgacggattgtaatttggtcatcgaaaacgaccacctttctagtcaaacgttaaaatcgtctcacggtgactgctgaaactagtcagcaaatgatgctaatccggacacgatttctaaattagaattaatgcaaccctaatgtcatttttgctgcccgtgacattttatcaagcgaccaggccggttcccagacaaggttgatgagtacctgatcgatacccgcgacggtcattaatgcgcttttgatatggtcattcaaatagcctgtcagtggacagcccatgatggtcagtgtcatggtaacggtgcagagctttaggtcagcatcgtaagcaacatcgtagatcaaaccgaggtcaacaatgttcacaccaagttcaggatcgatcacggtactcagagcggctaaagcttgggtttttaaagtagattgtgtatccatactaatcatgagaaagactcctttagaccaacagcctaagcagggtgatccgcttaggctgttaatggtcggttatttaatgaatttaacttgttcgttgatttttttaatctcagcttctttacgttcgttgaagatgaccttgttcttttcaaacaagttgtcgccattcgtatcgatggagacaattaacggaccgaagtctttgacctcacacgcccagagtgtttcgggcattccgaggtctttccactgggcatcaacaatcttattgacgtgcagggcggcataaacagcattgccagcggggtagacgaggtgtaaggcgtgatatttcttgcaggcccgttcggttcccggtcccatgccgcctttaccaacgattagtttgacacgggtttgttttacgaattcttcttcaaatttttccatccgcatactagtcgttggcccgactgcgatcatttcgtacttgtcatggccgagatctttaatgatcgggccagcgtggagaattgctcggtctgtcacgttaacgggtaggggacgatgttcttcgacgagccgccgatgggcaacgtcccgacaggttgttagtgagccattcaagtagacgatgtcgccgatacgaatgtccttaatatcgtcatcagaaattggggtggttaagtggtaagttttcatgataattcgactcctttgttcagtggtaagtcatagtttagatctgcgtcaaagttgataagtccgcgccggtgtgaccagcagccggtactaacagcgacgccaattgttgatgggtgtcgggcggtattctcgacattgacacccattactgacttttgaccgccaaacccctgtggtcccaggccaatgtgattgatgccgtcttctaataagtgttcgagtttggcagcattagcgtttggattttcactatcgacgcgccgcattaaagctaatttagaattaagcgcagccgtttcaacggatgtggcgacgccgacaccgacgagtaaaggtgggcaagcgttaatgccgtagctcgtcatgcgatccatcacgaaacggacgacgccttcgtaaccttcaccaggcatcaggactttggcagccccgggtaatgtgcagccaccgccggccatgtacacgtacattgagatgtcagtgccattaccatcaacttgcagaaaaatcgaggggatgccgtcaccaatgttcataccggtattgtattcgtcaaatgtctgaacagcattatgtcggagtggcgctttttttgtcccacgataaacggcgtctttcaaaatttgattgagttcgcctaatagtgggaactgcgcgccgcatttaatgaagaattgtaatgcaccggtatcttggcaacttgggcgtttaagtttattggcaagtaattggttttccatcatcgtgtcgtagacgagcttttggagtggatcgacttcgatcttactgagttcttcgagtttggcagtcacatcatctggtagtcgatgactgatgagtgcaatataatcggccaaaatgtcgcgcatccgttggcccttagttgataacgttggttcggtatagtcgtatgtcattgtatccatagctggtttcctcctatcaatttacagctacattgtaagtaactgtgtgatacaaaactaaccgctactcgccaagttatgccaggtatcagattgtgaaagtgatggtaagcggacaggtagccggttaaaaatgacaaaaaaataccaaggccttctgacgagtgatgccgtcgtaccttggtatgacccaatatttgatcaaaatatcggtaagttcagttgttcgtaatcacaaaaattgttatgccattaattattgattgagcagtgtttttaattgcgcgattttttgtttgagcgcctgatattcttgaaaatgtagtttatacatgcaactttcacaagcactgagttgatcagtacttgtgagttgggcccagtgattgagttgcttttggacaatggtagtttgtgtgggagtgagcggttgcttgaactggtcatattcaggacgctgcccgtgtgacaagtgttgacggtaactggaaggtgtctgaccaaaatgcttcttaaacattagattaaaggacttgacctcctgaaacccattggctaaagctagatcggcgacccttgtggttgggttttccagatcgtagatggcgtgttgtagtcggcagcgggttagatattcgtaaaaattcaggccgagttccgctttgaagatgcgtgagagataggctggtgaatagtgactgatttttgccgcttcgtttaaggtaattggtcgatcgtaagcctggttaatgtaatcaatgacccggtttagtgaactctgcgtcttgggttgggggtaagtcatcgtgattccagtatcaaagaaatcgtgatgtagcaggttcgtcaattgaaagtacagggcgttcaagtcaaaaattggccagtcctgctgatgtaatcctagatagagttgtgccagaatttggcgaatcgtttggtagtcacggtgttggggcgtcgtcacgctgttgagtagaaaagcacctgaactgaggtcgatgccctgactagtgtagaaatcgggcagaatatgtaaacggagcgcgatacattctggggtcaaggcaaaggtggcatggccgcgattggcattgatcaagatgaggtcatttgcgtgtaattgatggcgcgtcccgtcaacattcacttcgaccgtaccttgcaataaccataagagttcgatttgcggatgccagttgtagtggtaactaccaatcatgtatgttaataagtcaaattggacggttggagtggattgaaaatgctgactaggtatcatgacagtgtcctccttaggaataactttgattagctctagcttacacgttcagaagatgcttgaacagcagtcgacaaaagaatacaaagaaaaatgacaaaaattgactagtatcagttatgatggaaatataagtaatggtaactgaatgttggttgtggtcacgcttaatcaagactgaaagtgacccaggcacatcatcgttgttagactaaggatgaaatggtggagaaatagtggatacgaagataattgtcaatcatgcgctacgagcgcttttatacgaagtgacggtcaaccctaagcccgggctggtcgacccgttgtcggcgggtccccatccagacatgaacgcttttatgtttattgatagtgctttgagtctagccccctactttaatgcttgtgcagcggcgggcgtcgcgtatacggctgtcgatttgacgggtttgttcaagcaaattcggggcattggtgttcaagcggaacaaaccatgtttgcggcgaccaagggcgtgaatacccataaaggggcggtgttctcactgggcgtgctagtgacagcggcggcgtatcagttgcagcaccccgacgtcgacttagcaacgattgtgcgcacgatgctggcggggttaacggcaaatgattttaatgatttaaacacgaaggatccaacgaccttaactgctggagaacgtcaatacctaacatatggcatcaagggaattcgtggtgaagccgaggcgggttatccgaccgtgatgcaagtggcactacccgcattgagacgtagtcgtggcacgattaatcagcggttattagacacactgatggcgattgtccaggcgacggtcgataccaatctggtaaaacgggcacacgacccgcacgtcattgactgggtccacgaccaagcacaccgctacttcgatttagggggaagccgcagtgaagctggaatggcgtttttatgcgaattgaatcagatttttgtcgaccataactatagtttaggtggctcggccgatttgttgattttgacgatttttattggattgcagacagatatattagcttaataatgagtgtcgtgattgtaggtgacgacacttttttaataccaaatattaatggaaattaaatgacgattgcaatgcttagttgatgagtggtcagtgctttttagtggtgatggcatcgaaagtcgtttcagtaggttctggattaagcttttagtatgttggttgtaacgccttggttaagcaaaaatagtattagaatgaacgaaaatttaataccgattataaaaaagttaactatacctaacaattatttgcattagtgttaattatcagttatgcttatgacgatgtagaaaaccgactaccgcgatgaacggaggaaatgtgatgttaaaagtacaaaacctcaccgtggcatacagtgacacaccagtctttactgatgttgccgttaactttaacgccggcaaaattactggaatcattggtcccaacggtgcgggaaaatcaacgatgatcaaagcaatgcttggtctgatcaaatcccaaacgggaaccgtcgaatatgaaggtcgtgcgctaaaacaatttcaaaaacagattgcatatgtcgagcaacgtaaagatctcgacttaacctttccaatcaatgtttttgacgtcgttttgactgggacctatggcaaactcggacttttccgcgaaccaagcaaggcggatcgtcagcgttgccaagatgcacttgagcaacttgagttagctgatttagcacagcgccaaattagtcagctttctggaggacaattacaacgggtctttgtggctcgagccttagtccaagaagccgatatcattattcttgatgaacctttcgtcggcattgatttacagagtgagacggctatcatgacgatcttgcatcagtggcgtgatgccggcaaaatgattattgtcgtgcatcatgatttgaacaaagtttcacgctactttgatgatctcgtgattttaaatcacggtatcgttgattatggtcccgtggacgcggtctacacacccgcaaacattgaacggacgtttagtgctgatctttcggccgtcctgtttacgaaggaggaaacgcgatgatgcaatcaattacgacctttatggctgctttggggaagtatgatttcttacaaagtgcgctaattacggctattatggtcggggtcatgtcaggaattattggtagctttattattttacgaggcatgtcgatgatgggcgatgccatctcgcatgccgttttacctggtgttgcggtagcttatatgctcggtatcaacgtcctaattggtgcttcggtttttggaattctagccgctagcttgatcggattcgttgcgagccgtagtaagattaagactgacacctcaattgggattgtcttcagtgcgttttacgcactcggttttatcctaatttcattagctgaaagttcgacgaacttgcaccacatcttattcggtaacatccttgctgtgagtgatactgatatgatgacgacgacggtcgtgttaggactagtgattttattcgtggtcttcttctacaaggaattactgattacgtcatttgatccgacctttgcgaagacttatggtctcaaggtccaactgttacattacgcgttaatgctggtcttaacgctagtgaccgtttcagcgctacaaaccgtcgggatcattttagtggtcgcgatgttgattacaccggctgcgacggcctttctatggacagaacgactggcagtcatgcttggactgtcagccttaattggggtcttgtcctcagtggtgggcttatatctcagctacacgttgaactgggcttctggtccggccatcgtgctagtagcggctattttcttcggtatttctttcatcatctcacctaagcaggccttgttgccgacgctttggaaagggcaagcagcagcgcgacgggtgacagcatgaaaacgaaattaattgcactgattggagtcatcgcgatggttaccgggatggcagtatttctgaatcaacgccagcaaagtgccaaagcgacgaccactagtgccaaaatccgggtcgtaagtacgaactcgattctagatgatatggtgaaaaatgtgggtgggcagtacgtccaaaattacagtattgtgaagcgcggcactgacccgcatgagtatgaaccacggcccactgatattgcggcaactgccgaagctgacgtgattttttataatggcttaaaccttgaaactggcggtaatggctggtttaaaaagttagtgacggcttccaaaaaggactttgaccacgatgtttttgcggccagtaagggaattaaggtcaaatatttaacgacgaacgttaatgagccggacccccatgcttggttagatctcgccaacgggattcaatatgtcaagaacatcaaccggacgttgcaggccaaggatcctaagcacgccgctgtttatcaaaagaatacggatcgctacgtggcaaaactagcaaaactgcatgagagcgctcaaaccaaattcaagcagatcccgacgagtcaacgattattagtgacatccgaaggcgcctttaagtatttctcggcggcctaccatgtgcccgctgcttatatttgggaagtgaatacggaatcgcaaggcacgccagctcagatgcggacggcgttgaagaaaattgaaggaaccaaggttcgaagtttgtttgtcgaatcatccgtatcaccgaaatcgatgaataagctttcacaggagacgggaatccccgttgctagtacgatttttaccgattcgctggcagctaaaggcaagccgggtgatacgtactactcaatgttgaagtggaatcttgataagatttatgctgggctgactcggtcgtagtacttgggcctataattcggttgtgttgatgtcatgtgatataagtttgttctaaaaagggaggctgtgacataagtctctagaaacaaagcaggtctggaaaaatcttcggatttttccagacctgtttttgatataatagaaaataaaaaaagagcatcggtcgcacccgatactctacgaaattatgtgttaatcgcttaacacagcttaatcatcataacatcttaatcaatatcttgtcaacaacttttttttaagaagtaacttgattaatttgtcatagttgccgttgcgacaacagaaactatcttaccaattactgaagaaattgtcaacaactaatttcaataattatttggtggtgagatgcatctgccgtagcagcaacgtttactaatataccaattgaagtaaaaagtgtcaacactttttctgaattttttttattaatagtcaaaccagctttctttctctatactatttaattaaaggagcgactaaattatgctagcttggctaccattctttttgatttcattaatgtttattgttctactatacgcttgtgcgcgatcagcgcgcacaaatatccagcgttttaagcaactcagtttaattgcctttctctgggtcttaactgctttttgctatacacctaccagttacaattttggtacccaactcgttattcaatatattcaatggggacccgttaagctgaacgtgattcctttccaacaacttgacattgaattttggctcaacgttctcctcactgttccattgggcggtttactggcatggaattttcccgacttgccttggcgtcgttttatttggttgggatttcttacggggctaacactcgagctgggacaattcatccttgactggttggttagcctcaaacgttgggttgatatcgatgatgtcatcacaaattgggctggtgtcattatcggtgccgctggttataaaattgcacgtcatgttcccggacttcgctggttgcaaaaataacgtatatatagaagcaaaaagcaaaacaacgtttgtttagcacccacaagtgccaaacacttcagcgctctagctgttatgaaatcgtaattaaataagcgtcgcagccacttaaggttgcgacgcttatttaatttaactactaactattaatgaagctgccatcatcaggattcaaaaaacagatcgaatactcgcttacgatcttggttccagacttgattgtcactagttggataaactcgatttgttaacacaaccagcccaatttgacgatccaaatcaaaagcaactgccgggccagtaaaaccagtatggaaatattgatgtcgtcccgcacgtcgttcccaacctaacgtccggccattttcgtcatactcgcctaaccagtcaaagacattttcatccagcacccgtttgccttgatattcaccaaagtttaacatcatttcaataaatacggataaatccgtcagcgttgagaacaagcctgcgtgaccactctcaccattcaacaaaaaggctttataatcatgcacctgtccttgaatctgaccccgccgcggatcaaactccgtcggcacaaaccgaatcttcggacgatttaagttataacccgtattggtcatcgctagtggatagcaaacgtggtcttgaatactccgagccaatgagccgtcaaccgcacgaataatccatcccaataaaataaatcccaggtctgaatagacatacgttgtccctggcgccgtgacgagtggcgcatcataaaccgctttgatcagatcttcacgttgcatcttatccaggttatcaatatctgccggtagcccactattatgaagtaacaagtttttaatcgttatttcaggatgagtgaacccaggtaaaaaccgggcaaccgagtccgttaaatgaatcgtgtggtccgataacaactgaaaaatcctcgtcgtggtccctacaaccttagttaccgatgctaggtcataaatcatcgcaggatctaagcccacggcaaactcatcgcggccctgcttaccatgatagtattgattgatacctttaggggtgatcaagctaaacgacgccccataaatgtcgccagcttcaatacaactgtcaatatattgttcaattttttcgagcatccgcattacgcccacctttcactacattcactagtttctgcttatcttctttatgataacgaacttcctcataaaatcaacggcaaacgcttttaacaccctccacacctcgttgcactttttattaattaactagttaaacacttgttacattatggacaatattccacttatatatcaaaacaagtcttgtttttagccgttttctaaatataattaagtgaattaccaatgcctatctagctatgtaagtactgttatatcaacgttaatagtcaacttttcaataatagattgcaaaaaaataacccaaacgtgaaataaatcacctgaaagcggttacaaatccagcaaaaaatgttatgattcaaatatagaattttatcaatcatttgattggattcaaattatggaggcgagaaaatgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggatgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattcgctcttctctggtgacccaatctgggcaaccttatcaatgtgtggtttaggcgtcgacggtcaacaccatgtgactaagaccgctttccggattttaaagactttggacaacatgggcgccgcaccagaaccaaacatcacgattttatggtcagaccgcttaccagaagacttcaaacgttacgcaactgaagtttcaatcgacagttcaaccattcagtatgaaaatgatgacttgatgcgggtacaatggggtaccgattattatggtattgcttgctgcgtttccgcacaaccaattgctgatgggatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggattggttagctgacacttacgttaactcactgaatgccattcactacatgcacgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacaccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacctgaacatcaacgtcttcaataaagacactttgattgatgctcagaaacaccctgaagaatacccaacattaacggttcgggtttctggctactgtgtctacttcgcagatttaaccaaggaacaacaagatgacgttatttcacggacattcttcgaatcaatgtaacatttaatctttaatagttaagaaggcgaaaggctcatggaaaacaaacaagtttcaacaacgcaagcggcggcaaaggagcctttgataggctacgttcactccatcgaaacgtttggctccgttgacggaccaggtatccgttacgtggcattccttcaaggatgccacatgcgttgccaatactgtcacaaccctgatacttggaaactcaacgttggcgatcaaatgacggccgacgagattctcgaagacgcggctaaataccgggctttctggggcaagacgggtggcatcacagtcagtggtggtgaatcactggtacaaatcgacttcatcttagacttattcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaaaattccaaacgacgtcgttcaaaaagtcgaagtattgccgtaccatactttgggcgttaaaaaatatcatgaaatgaagatcaagtaccggcttgaaggaatcgagtctccaacccaagatcgggtggcaaatgccgaaaagctactgcacactgctgattacaacgggtacaagacatggatgccattgccaaaactttaaatcggcatttctagcatgactaaaacaccagcgatacaatcgtctacggatggttgtgtcactggtgtttttttgctggctcgacgcatacacgtattgctggctggaattagcacagcggcacgcaaaaaaggcgccgcgagcctaaaccagcaacgtctttccttaatcatgccctatccaatgaccgtcagcccttggactggctgcgaacaggccggccactaactatgaatgcctagttccattcgagcttcgcgggacatcatactttcgttccaagcaggttcccacacaatctcaatctcgatattgttaacttctggtaatttgatcagttcatcgtgaatgtccttagccaaccattcggtcaaaggacagcccgcaatggtcaacgtcatggtaatttcagcggtcccctccgccgtcaattgtgcatcatagatcaaccccaagttaactagatcaattcctaattcagggtcaatgacatgtcctagcgcctcgaaggcccggtctttaaacgttgttgtcatcgtatctcgtccttccataccagcttgaattcactgattaatcacgccaacgtttcgcggtataagtgccaccacacttgatacacgtcatcgttatataaagcgctttcttgtctacttctattgtaccgtatgtcagcccatattcaatcaattattagcgctaattaaccgacttttcaaacggtcggtcaatcagcaaattatgcgactatttctcgaaaaaaattcactataatccccgatatagcagcgttttgagtcactattgatttttattgcgaattcacggttgtttttgttgtaagcgtttgcggtttatgctattatactaagtgaggaaaggaattaatcctcgattagcaaagcttctcaaaagagtttggctgtcgctgtaatgttagacagctagtatcacagtttgggtcgttatcgaaaccgttttaagcgccgtgaagcgttatcggtctagcgagtgtcgtgagatttacgttggatgactgaacgttgacccttagataaacgataaccgcaaagaattaattggcattagaatgacgaacagattttaactaagttttagttggaaacaggtgtctccgatgaccagttgttagttccacattaccagttccatttgtagactcaggtattacaaagtttaaacggaggtgcatgtctgttacgaagacattcccaagttttaaacgcgagtttgactttcgttaaaacccgtctaacgagtcgcaatcaagtaacaaccttactttagatcgactatagcagatagttacaataaatacgggttagtccgttagaagttggacacgcgtaaaattgaatagcatgaaggtgtatcatattaacactgaacaatttttcattgctaatcaggattattcctcataagtagaactcaagcagagaagccttgggttctatttttttgctctaaaatcagatttaccaacagtcggcaccagacgtaaccgtttacatcctcttacgaaaaccgtatactgaatttaaatcaagttgcacattgaggaggactttagttttgaaaacgattaatttaggtcacagcaatattcaagcttccagcgtggcgcttggcatcatgcgcatggacgccttggatgtcgctcaagccaccaaggttatcgataccgctgctgatttaggcatcaattacgttgattcagctgatatctacggtggtggtcaatcatcgaccatcttcggtcaagcactcaagcaggctcacgtatcgcgtgatcagctctatattcagtcaaaaggcggcattgttcctggcaagcgttacgacttttccaaacagcacatactggcagccgtggatggcgagcttcaacgcttaggtgttgattatctcgacaccttcctcctccatcgaccggacgccctgatggaacccgaagaagttgctgccgcttttgacaagttgcaaactagcggcaaggtgcgccactttggcgtctctaacttcaatcccatgcaagttgacatgcttcaagcggcactaaaccaacggctcatcattaaccaactccaatttggtatcatgcataccggtgcgatcgactttggcttgcacacgaacatgcaggacgaacgtagtcttaaccacgacggcgagatgatcgaatactcacggctccataagatgacgattcaagcttggtcgccttatcaatacggtaacttcgcgggtatcttcttagacaatccgaagtttccagaacttaataatgccatgcaagcactcgccgatgagaaacaggtcactaaatcagccattgcgaccgcatggattctccggcacccagcccacttccaagtcatccttggtacgatgaatccggaacatctagctcaaaatgctgctggagcagacgttacgctttctcgtcaagaatggtacgacatttactttgcagctggcaacgatttaccttaatcacgatcgacctaacagaattgacgattagtttttacaaccaaaacgacgaccccaaatcaggattgattttcaggtcgtcgttttttagacgtttcactaacatttttgatgtactcaccacatctacgcgtatacttaatcctatcaagactcaggaggcgagcgaatgacatccacttgcacgatctgtgaacgaatcaaactaattcaggcacatcagaatccttatttcgtttacgaactcacaacgggctacgtggtccttgctgatagccagtactttgaaggctacacgctctttttagccaaacatcacgttaccgaattacatcatttaccggcacacgagaagttacgataccttgaagagatgagtatcgtccaggaagcttgtgcgcaggcctttcatgcagacaaaatgaacattgaactactcgggaatggtgacgcgcatgttcattggcacttatttcctcgccataacggtgatacgcccaaccccggtcccgtctggtggacaccgctggaaacaatttatggtgatgatgtcagtctagacattccccatttaagccggttaaagcgcacgctcagcgtagcaattgaggccacgcttaatgctcgggaagcagaattgcaggctttagaggcactcacaaggcctgctagccacagaattgacagcaattagaccaaatcaggacccagatccgcttagatcttggtggctacaccccaattcttaatcgcaatccgtcaccgtatttcaaattgccaaaatccacctatttatccggccgactatcatacgcccgcttagatttatagccagctcgaaaaaccgtcttcataacttcaatgtgccgttccttagttgcttgtgccttagttccaaaaataaagcgggcccattcgcgctgataaccaggtgtcaaagccacaaagaacgtttgcaattcagcatcaaccgctaacaattcggttaccgccggaatatttttttcaaatgaactgaggggtgctgtactcataatcaaacctccgattagttttacttaaatttactgtaagaaagggaaaatccctaattttcaggtttttatatttcgaattttcataaaattgcgctatcattatagtataagtattattatttgactactataattaaccatactgctattcaccaaggggagccctgctatgccaaaatttgatatcaccctcatcagtcccgaacgcgctaaagcgatgttgactgaatataaagaacaacgtaaaaactctgtcccacatctggcccatcctggccgctatatcttgccggattacaaattaactcgtcgccgggccgcattcaaaattgttaaacatacctttttaacgccccactacaagtcttacgttgccatggactctgacaacggccacacactctggtttcataatttcggttccctaaccgaagctttattctggttagaaaccggccttaaaatcagcgataccgactcccattctaactacaaggaatggatggctaagcacactatggaaatcgaaaccttcaaagacttgctgcgcgagcagaagcataaacaagggcccaagactaagaaaaaagccaagtagcccgttttgacacctagattcagataagcagcagtacgcccattagcgtgctgctgcttttatttacgatcaactgtgccattcattactgactaggccaacctaaaagtggctatccaaaaacgactgcagcttgcgtgcaatcacgcgatgaccggcattgttcggatgcaaagtatccaccgaataaatggccgcttgagcgggaatcgcaaacgtcattcccgcatcacggtacaagctcaaatgtgggacgccatagtccgcagtcatctgggcaatcgctgcttcataatctgactgacgatacccgagaccattagtcaccgcactaaaactgccgccaaaatcagagccaatatgaattgctgaaataaataactcggccaattcgtctgtaatcccgtcagtaacaccattaacgcgccataaaatgtcgtcatatcgcaatcaccgtattgccctaacggctgattccgaccatagtcattgacgcccccaaagacagcaataaaatcagcatcttcaggaatagcttgatagcgcgccgccatcgcatcgtagcgactcccaatcgttgaaccagagattcccaaattatcgctccgctcgacatcccaatcagccgccaaaatatcatgataatgcaccgtcgtcaacccattattcgccgtaatcgaatctcccaaccacgccggccgcttaaaactaacatgcccattactaatcgccatagccaatcctccctttactatcatcgctatcattctaatccatcccatctgaattatggtagaaagatgccttttagggttggttttctgttcgtcagccggtgagcgtcctattccgacctccggggctgggtgacaattgctggaacgcagccgacatcgatttgagctaacgcataacccgcgtcatctcaaatacgagtcttattctaagccggaaggaaatcacttccgactaagaataatttggctactgagcattgtcacccagcccctccagtctcaagccacgggttgaagccgagcattgtctagccaacggattaatgcggtttggacatttgtccgttggcatagcaagcacagactttagtggcaccgaacacgtttcggtaagccgcccgaatggctgatgaacggccacttaacttggtgcaattggtcgttggctattttgataccggaactttaaacgagacgttagggttaccctaaccactttgttgaggtgttctattattactatagtaattccgaaatagcgagctatcccaatatcttttcgacctaacagttgattaataaaattactgtttatggagaacaatgacaaattcatcaaaagttgggtatatcttcgtccaccattcgaatactgtcccgaatggaaggcgtttcggccaatgctcagcggtgaaattccacttagcaagcgtccttggattggttagtagaagaccagtatttaagacgtggtcttcggcttaaatctgtgtccaccgcgttccagcaattggcagaaatgcctggagagcggcgtaggacgaacgaactaagcaggtttacgctaaccggaactgtttccagcgggcctaagctggtggttgttgactttaaataaaggcatctttctaccattatttcaaacaggtgggccaatcttaaaaggctcgtattatggaaatccataatacgagcctagtttaattgatatatttagttcaactgagtagcgctaatcggcttccgtttcacgtttccgtgcagtacgccgttcgcgtgcgtagtcagttttagttgtgatttcaacgtcacgtgctagccgtttccggcgtgctaattcagctgctttggcattggctttcgcagcttccttgactggatcagtcgttaagtcgtgatggatcgagtacagtaagacgagcgcgacaatcgttaatgggaagccagacatcgcacagatggactgaatcgattcaaagccaccgaccgtgacaagccccaatgagaagactaggaagataacgacccagctcatccgattgaaacgacttggttgttcccccgcggccaactttttactagtaaatgacgaggtaatgaaggcaaatgaagataccgtcgttgctaagaaaataaagcaagataggcagtacaaagccagcataatcatcttcaatggtaaggtcgacaatactgctgcaatcacagcggcttgtccttgcgtatttaagatatgaactaagttaacgatgcccatccgttgcaagtataaggcataaccacccaagatggcgtagaaactgacacaacctaatgagccccatagcaacataccaccgagtacctgacgaatcgtccggccccgagaaatccgggcaatgaataagcccatgactggcataaaggataaccaccagccccagtagaagatcgtctgccgttgcatggccgttgcgtgaccatttggtgcagtattcgtgctcaacgtaataaacttattgacaaacaagccaatactattagtttctgagtttaaaatatacaaagttgggccaacaattaaaacaacgattaggaagccaatcgctaaccaaacatgggcagcacttagccgaccgattcccttcttcaagccattaaaaacagccatggcgaaaattacgaataataaggcaaataaccctaactttaaagtcatcgtatcggcaatcccggtaacggcactcaaaacttttgaaatgacggggatttccatcccgactgaagtaccaacaccacccataatcccaataataacgagaaaatcaatcgtgttccgggcaatttgcttacccttaccaggaccttgtagtactgaaattgcagcactgagccgctgaaccttgatgtgtttaacatacattgcataggcaattgcaatcgtggctggcgcaaacatcatccacgccattggtccccaattaaattgtcccagcatgtgcgcataattatatgcagaagttgaaaacggcttgacgccgaatgaagggctttggaggtaccgtaacgggtcaaccatgctcaacattaagatgctggcatcgatcccggtcgcgtaaaccatactgccccagtgatacgttgaaaattctggtttgtcatcaggatcaccaagtttggttttccctaacttactaaaccctaagtaaatgaaaaagataaaagtgatcacatataccgacatataaagccagctcatgttatttgtgagccagttcaagatgccacttaaactcgtctccagcgaatggccccccattaataaaacaacggaagccgccgcaaagagcccaattgttggtaaatagacccaccaatcaatattcttactttttaaaataataaacctgctactgagcatatactctctatatttagatcaaattcgtggttcttcctaccagcaatggtagtccccacgcgtaaatttccgactagcaatcggtacacccctccgagttaatcctcggagcactcagcaccctgactgtatcaggtttgaccggcattgtcatccgcattctgtttgtgctaactcaaaatcagtagcagaatttccttctttccgttggttgaatccggacaacgccatactgacaaatgatttttaattgcttaatcgacgttggtgttcatcttgtttagctagtgtttctattaccatcgtgcctttagcacacgaccgtcgtcacaccacgtaacgattaatggttacactgctcttgctaatagataacccccttgaatcaccagataagcccaccgcacaactgttagattaattgcttggtgcaccaaaaaagcgcttagtaccgggtaacaagttaccacctgcacagcgcacgttggcttatacaaatgctgatttcagtattttctgatatctgatgttcgtttataagtatactagtattaaatcagaagtaaaatcaaccattttgagccgtcgaggcctaacccgtcaaggattagacgagttttacacccatattttttctgaaactttttaaaagttttcgtaataattagtttttagtttagaatcattcttatctgtttcaattaaaccgatttcatgttattcttgtaacaagtaaaaaaacgttatcatctaaaaggaggggaactgcatgcggcactactataaattaattttaacggtcagcgtcggtatcattgcggttattttacagtttggtttgcactaccaattggcagcacaaatcatcattacattaatggggtcacttatggccttatcaatgttagttgagatgatcaaaaccttacgttcaggtaagtacggggttgatttattagcaattacggcgattgtggcaacactagctgtcggcgaatattgggctagccttgtcgttctaattatgctcactgggggtgactcgttagaagattatgcggccaaacgagcgaataccgaattgaaagccttgctcgataattcaccacgtattgcccaccgctcagtcgccggccaattaacagatattgccgttgaagatgtccaaattggtgatcagctagtcgtcaaacctggtgagctagttccagtagacggtcaccttattcaaggaacggcactctttgatgaatcttcattgacgggtgaatctaagccagtcgacaagcacgttggcgatgacattatgtctggtgcggtcaacggcgatagtgctgttacaatggttgttgataaattagccattgatagtcaataccaacagttagtcaaattggttaaagaatccgaatcacgaccagccaaattcgtacggctggccgatcgctatgcagtcccattcaccttggtagcatacgtcattgccggagtagcttgggcattcagcggtgatccccaccgatttgcagaagtcctcgtagtggcttcaccttgcccgctgattctcgccgcacccgttgcactcgtctcagggatgagccgaactagtcggaacggaatcgtggtcaagactggggacatgttggagaagttatctacggctaagtccgccgcgtttgataagacggggaccattaccagtggtcaattaacagtcaaccaaattgttcctcagcctggttttactgccgaacaaatcttgcacctcgcagcgagcgctgaacaaaactcaagtcatatcctggcccgctcactcgtcaagtatgcgagtgccactagcctcagcccggcaacacaattagcagaagtaacgggtaatggggtcacggcaacgattgagcagcaacaggtcaaagtgggcaaacttaaattcgtcgcaccgactacaaccgccaagccacttgctaccactgctatctacgtcggcattgatgaccagtacgcgggttacatcacgtttatcgacaatgtccgccccgaagcagccgccacgcttcaagcactccacgctgagggcgttcaaaacgtcatgatgcttactggtgaccaacaggcaattgctgatcatattgccgccgatgtcggtatcgataccgttgctgccgacctcctacccgcagataaaattgcccacttaaaggctgtaccagcgggcgaacgccccgttatcatggttggcgatggtgttaacgacgcgccttccctggctgttgctgacgtcggcatcgccatgggcgcccatggctcaactgctgctagtgaatcggccgacgtcgtcatcttaaaagacgatcttagtcgcgtggtcacggcggtgcgcattgctaaagataccatgcaagtggctaaacaagccgtttggattgggattgctatctgtacgatcttgatgttgattgccagcactggtatcattccggcactctttggcgctatgcttcaagaagttgttgatacggtctcaattctttgggcgctacgtgcattacgggatcggccacaatcatcagtctcatcaacaaccacaactcccataacaaaggatgtgagctaaccatgccagaatggctcttacgatgggcacaatcggcactgacttttgtcgttgttttaacgttcgtttcagtcgttttactcaacgtaccactaaaagaagcaattctcgttgattttgcttacatgctattaacgctcgccttcgattggtaccgcagtcggcaccatgcctcgcgctaattattcaatctaatagtcactaacgatggttttaccaatcattaatcaaaaaaatcgttcccagatgtcttcttgggaacgatttttttagttaatgctcaatgcttcggtttagggtgagaccgtccacttacattcaagccttacttggccaacatataactaacttttacgtcgtccataatcgtggcaagtggtaccacatcatcaagcaaaattgaataccaatgtttcttattcatatgatagcccggtaaataatgttgtccatcaatcagcatagataagtcttctgggcgcgctcgcaaatctaataccgtcacaacatgtgttgcgcccggcaatgccagtttatcggaagttaccgtcaataatgcgccataccatttgtgcgtgtctgagcgtcgccaaaccgcgttttgtggaaatttaggccacaagaactcaagatcgtcaccataagcagctttgacttgcgcaatcagcttacgctccggggtcgattggaagacgtcattatcgtaacaatgctgttcgatgttgtataaaatatcttgataggcctgcgctacttgacctacaaactgaccatgggcttgggatgtcaggtgtaaaacatatacttcactagtcgtcgtatccgttaatgtcgtgttcagactgccatcagtgttcaactcgattatcatttcaaattggccttgcataattaaagttcggaactgatactgaccattctgattgggttcaaatccaaactgactgagtttgctcatattgacccgtttattctcaaatctaactcttgccatctgctgcgcctccaacttcattcccacttatcctgaatgtgatgttcgactattgcaatccacaaacaagtcaacgcactcgttgtcgtttgatagccgctatatcattttataagtaatcacccgtaaagccaattcaattgaccattgctgtgttagtaagccgacctttcacaacaattaccattgttccaatcagccaatacttgcgctaaagctcagctaatcttgaaaaaacttcactaactcgtttttattgtttttttatacccgtccagccacaatctatggcacaatagttgataagtactggcaattgatgacctacttggttctttaaaccagcataacacaatcattttggctcgtggtattaacacatacatatcgttggttatgacctgaccctgtaccaaatatctttttggtcagcacagaaccatgtctgcgctgaccaatttactaaataataacggaggtcctaatttgaaaaaatatcgcgattatcgtaccgccattgcccgaacattgaccatgattcaacctaccgatgaaggcctcgcaaagggtgccaaagcgattcaggaaatcttaaacctggcgcttgatcctgataccatcgtagattcggataatacacgcatagctagactagccactagtaacgcacacaatgagaccagcggccacgctacgcaagcaaacgcggaagattcatcatcatccgtcaaaacaacttctgcacaatccaatgggcaaacaatcatgcaagtaaagcgcgatttaaagggttttgatttagtcgaccccaatgatccgaccgtcacaccacgctaccactacgatgaaattttggcccgacaactggtgattcaccacgatgatcaggtcctgttagaacaaaatttacggcaacatcgacaaccttatattgataaaatcgttagtcacgctactacagcggatccgattactgtcgcaccatttttcgttgttcattatcaagacaccgatgatacttatcacatcgaacaagattataacggcacaaccttatcgtcgctcaatccggcaatgaacgatgttacgttcactagtcaagaagcgcaatatcagcgcatcagtaatggtcaattagtcgacctggcttggtataaggagcggcctgagaaggtggttattcgttacgttcatcatagctcgagtcaaccgacctcgaataaagcagccaaaccagctaaaagggctactatccacacaaccaccgtgccagtgacgctgcgcaccttagactttgatctgcacgaaaaaacagttgccatcgtcatgggcgacgttggtacgcgccgaacacagatcacgcaactcattgatgagcacaacgggcacaccttattgattgatgcttttaaacacagtaatagcaccaacttctattaccggcaaatcggtcaagcagacctcgtggtcatgattcagaatcagaataaacacgccacttccaaaacactgaataaagctgtcaagcattacggtattaaaatgacgattgctgatggcggcgggctgcagcagattgaacgagccgtttaccgcggaatcgctgatcttcccgcttatgagagtggcaatcccattagctacccccgcattaatgacgcttcacagtagcagccatttagcccattaaaaccacagtaaaagccccgcagcagctaactaaaacgtttagctattgcggggctttaaacatatttcggcacaagccttaaactacatcgttgttcagtagcagacacatcatagcctaatttcagtcaccgaacgattgtacttaaactgtttggcgctggttatcctgaatcgcaactggaataaagtcaaaggtcgcgtaatcgaataacccccgtgccgttaacttcaacgttggaatcacgggtaatgtcaaaaacgatagcgtaatgaacggatcaaagctaagtggccgctcgctaatgacctcatacgctcgtttaagttcggccaactgttcagcaactttttgatagctcgctgcagacagcaagcccccaatggcaagcggcatggtcgctagcacttgttcatcgtcaacgaccgcaattcccccgttatcttgggtaatctgggctaccgcccgtaaaattgcagcatccgacgttccgaccgcaacaatattatgagcatcatgcgccaccgtaccagcgatagctccctgtttaagtgcgaagccatgaactaagccgacgcccaccttgcccgtgttatgatggcgctcgatgacaaccattttgagaatatcacgttggcaatccgcttcaaaattctgcgttgcatcaatcgggagtgttaagtgatccgtctcgatatggttcggctgcacaccaattacatttgccaacccggtcgctagtggtaattggaagtcggctagttgtgcatggtgctgaacacgcgttgcagtaaacggcaatggttttgtcgtgcttggtaatatccactgtccccgcttcatcgtccgcgcaatcctaacgtgttcgagatcatctaagaccactaaatctgccaactgcccggctgacagactgcctcgatcacttaaacgatgcgccatcgcgccgttgagactagccaatgtgtaggcaagttcaggacgcatcccgctctgcatcgctaggcgcacgttataatcaatcgacccttctgtgagcaagtcactaatcgtcttatcatccgtacaaaaagcaaaccggctagcattagcttcggtcactgcaccaatcgtcggcaaaacatcgcgttcaaccgtcccttcacgcaagaaaacagccataccagcccgcacacgatcctgtgcttccgccactgtcatacattcatgatcagtatccagtcccgcattgcgcatcacattgagctggtgcgcattcaaaccggcagcgtgaccatccgcatgatagccatacgcataggcatcactaattttagccagggtgtcagtatcaccacgcgcaacggccccatagtccattacttccgccagtccccgaacctccgactgttggtaaagtgggcgcaagtcagcagcatgtagcgttgccccgttatcatcaaagggaacacacggtaccgatgacggtagcataaaacagacatctagtggtgtttggcgcgcatcatcaattaggtactgaatgccagcaatacccgcaacattggcaagttcatgtggatcagtcgcaattgtcgtgacgccgtgctgtagtaagacttttcccaactcgctaggtgccaccatcgaactctccatatgcacatgtgcatcgatcatgccgggaacgatccactgaccggtcgcatcgacatgctgggccgctatgtacggctcgtcacgcaagttactaataatccggccgtgatcgatccacaaactggtggcttcaaattcacgggtataaacgtttaacacttgtgcaccagtaatcaccatttcaactgtcttcgtcatcgttattttctcctcactagtcagtctgcctacggagaaagcaaacgggtccacacggcaaattaagcagtgtagacccgtcgactcaattcgcttatagtccagtgtttacggcactgggtagaaactcgccatccatatcatggcattatataggcaattagttgtattgataaattgttccttactttaccagccttttcagttacatgcaagccctaattatcataaatgattggtacaatgaacttagaactagacatgaatattcacctaaatcaatgtcgggtctgccacaaacagcgctggcattttaaatgaacggcatacgatttgcgacaaggtcccttactggtgacgccatctaaccagaatgctgattaggatgttgttctgcgtacattgaaacgcaacatgttccgataatggcaagcccgtgaataaaaccgtcggccgttaagtcgtcttttataatgatttgcgagcagtcgcctttgatttaaagcggacccgctacgattaatcaacagtcatatttttaaacattcttttgctgactataagttcatttacgtttacaataaagctaaattaatattaatatacataactattttttaggagctgatgattttgatgatgatgaataatccgaccatgctctcatacattcgtcgggaacagccagtactagagcggttgttaaccaattatcccaaacagattacggcggccttgactgccacccctgatcatccacaacactggttgatcctcgcaactggttcaagactcaacgccgccaacaccgcccgcttatacatgcaaaagacggccgccctccaagtgaccattgctgcggccgacctctacgtcacttatgaggaagctgatcccagtgtcgatgttgttatcgggatttctctaaaagatgatgatccaaccatgcaagcggcaatcgaaaaagcccacacggccagtcaagctcatgtcattatcgtgactaatcaaaaatcgactgctctgaccgcaatggccgatgcaacttgtgacttactaactggcaaagaatcagtgccctatattacactaagctttcaagccatcgtgctcactttaatgttgcttgccgtccgcagtgctgcccttcaagcacggttaaccgaattagcaatcaatcaagaattagacgagttcagttttctgattgaaagcatgaatccaactgttcaacgggcgaacgacttctaccgtaagttcactattgatttcactaacgcccctcaatttacagctatcggtgctaacgtcctagctggaacactaactgaaatgcaagccaaattcaccgaaatcctccgggtaccaacgcatggttactcattagcctcatttacccacggtggctttatggggacgcatgaagatcactgtcagttctatcttgaaatcaatacagatccagctgtcatgacccaattacaggccgtcaagacgtacgaatcgcgattaacgccccacatttataccatcagtctcactggtgaccagccgaccatcaatgatgatcaaaccctccagctcgaagccgttgctgatccgtataaagccccactacttgcgattatcccgttccaagtcttagcttggttcattgccaaatcacgcgggatcaatttgaaccatcccatgtacgcagattttcaagcggctactaaactcaagtaaagattactaaatcaacgcaaaatgaccagtatcgatattcttcgatactggtcattttaattaatgctcgttttccgtaactgcgtaataccgaattctcttatgttgacgctgcgcatagccaatttcttgcctagtccgctcaccaatgtagccagcaacattaatgaccactacttcatctgccaagtcgatttttttcaaatgtgtctggcgtaaattctgaagttcaattggtgttaatacttcatcactgaaaactggctttaaaacaataacaccttgtttactcagagccagttcaaccgtttcaaatactgccgcatattttctagacccacataaagtaactattttaacagtcattcgtcaaccttccctaaagtgaactgatcgaccaacgattaaacctccgtcgcagtcacatgcttagttttcactgcagtttgctgattcaagtgcgccataccaacaccagtgaaaccactgattaccgagataactggacaaagtaaactgaagaaaacaaacggtaagtattggacggtcggtactcccagcgtcgtcgtcaggaagacgccgccaacgccccacgggactaggtaattgattaccgtaccgccatcttcaaggacccgccccagtgcatttccggataagccaccatcattgaatgcctggcgaaaagcgcgccctggtaagataatcgaaagaaattgttcaccaacaaacacgttgacaccaatacaagttaatacacccgctaatactaacttgccatcgctattcaagtgcttagcaaccggcgtcataatttgattgatcagtccaaacttgaccaacaatcctcctaaggatagcgtaaccacaattaacgcaaccatgctcatcatgctgacaattccgccccgtgaaagcaacgtatcaacactcgtattccccgtcttcgaaacaaatcccgtgttaataatggcggttaacttcgtcattgatagcccaggctgttcaaatagaatcaagcccgccgaaataaaaatatttaaaagcatcgttggaatggctggcattttaaacccggcacaaatgaagactaagacgattggtaataatgccaaggctgagatactgaaatgaccatttaaaaccgcaactgtttgattgatcttggctaagcttgtctccgtattactgtgccccagcatagcaaacaagcctaatgaaatgagcccggccggtagcgtgctccataagatatgcttaatgtgcgtaaaaagatcagtatccactacggctgaagctaaattattggtttctgataatggtgataatttatcgccgaagattccaccactgataattgcaccggcaactaaggctggattcagattcatggtcacgcccatgccgaaaaaggcaattccgaccgtcgatgttaccgtaaaggcactgccgaccgccgcaccgactagggtacaaacaataaagactgatggcaaaaaccactgaatattaatgattttgaatccaatcaccatgagtgtgggaatcgttcccgccgcaatccaagttgaaatcatcgcaccaatgagaataaagatgaagattggcacgattcctttatcaatgccctctttaatcccggcattaactgctgaccatggaaaaccgcgcaacatcgcccaagcagtgacaacgcccattgcgagtaatacgggaacttggggcgataatccccaaccaatcacacccgcactcataattccgaggacgaccagtaagacaatgactgcttctaaggtactaatttgtggtgcttttgttttgttcataatttattaccccttcgattgataaaattccagtgacgcatattcatcattaaaattttaatatcgtgcaatcccaccacagcgttgatttgtcattattctcatcctcttcatcaaaaaaaaatcgtccccattgttcatatgaacaacagggacgattagactagtcgcggtaccacccaggttgcggattattgacacttaatccaccactcactagaagataacggttctagttattatccgttcagtcgaaactcggttaccgtatttcaatcatagtagctgaccggttcgcagcaaccaccggcttcctgacacctaccactatgtctacttgatgtaacgttatcgtacagttattaacttgtgattaacaataccaccatcttttatcatcgtcaagccattttataatataattctcattttaaggttacgaccgcgttacagctcgcaagcgcgcttggtgagcaaaagtgatgccaccaaatagtaacgtccaaataatcgcaccgattgcaccgacaatatcagcttgaatgaagaatagactggcaaaaataagaacaaaaaaggcaatcgtcagtgggctcgtgattcggtacgccggcatcttaaacccatccgccagatagtcattagatagccggtacttccgatgggccagcatcgccagcgtgtaaacaatcaggtacatatcactagagatcccggtcacgacggtaaaaactgccgtcgttgcagcacttaaactcatgatgggggtcactagcactagtatcgcggacaacacgattgctgctgccggcacaccacttttcgaaatctgaccaaagatttggtgcatgcgactcgtaactggcatttcagtggctagctgatagaagtgacgtccagctgagaacaaacaactatttagcgatgaggctgccgacgttaagacgacaaagttaatgatggcggccgctgctgggtaccctgccaacttgaagacttgcacaaacggactgctatcgggtgacagtgacgtccacggaataatgcccataatgacaattaacgcaccaatataaaacaacaaaatccgcaacaaagtttcattgaccgcctttttgataacgcggtgagggttcttggcctcaccaatcgttatactgacaaattcaatgccctgaaaagcaaagaagaccattggaaatgccgagataaaattagctatcccattgggaaaaacctgataattatggaacaaattgccgattgaagcctggcctaatggggttgggtgatgtcccaccatcatgaaaataccagtgataatcagtgcaacgattgcgacgatcttaatcatcgcaaaccagaactctgcttcgccaaataaccgtgcagccgttaaattaacgcccgccaaaattaacaggaagctaatctcaattagccaggcggggacatttggtaaccaaaatttgacatacgttgccgtagccgtcagctcagccatacagacaaaaatcaaaccgatccaataggtccaccctgtaaaatgaccaacactcggtcccaaatagcgggaaataaacgccacgaatgtgtgttgggtaggatcagaatagaacatctcaccaattgcccgcatcattaaaaagaagaagaagcccaacaccaagtacacccacatgactgacggtcccgtctttgaaatcgtactccctgaaccaagaaataatcctgtcccaatcgtgccaccaattgcaatcatttggacatgccggttactaagtgcccggatcgtgccatcagcattagttattttcataagatccctccacaaattttaatgactttgttgttaaatcttaatgttgtgtcattatagcacgctctagctttcacttaattgcgatttttaactgttaacccctgtttttaacgacgaatagatcgcaatactttgttttctaaagctgtcctccttattgaaaacgtcaccaaagctgtagttgctgcgtttgaccgcctaatttggcgctacgaaaaaagccgcccgagtatttacccgaacgacctcatttatttaatgcacccatcctgacacaataacacttaccacaaaaaggcaatcatcttgtgagcgacacttggattctgattcaacgcgcaatgcgccgcctgttccccactgtagaaagcttcttgatactgtgttaattttccgcgcaacaagtaccgaattgagcgcgctgaagcgacacccacaaaaccatcattgttataccccgtgtttgtatctccatagacattgagtagtttcacgttgtctggaaaattgtggcgatacttgagcatttctgaaaaatgcttcgtgaaacgacttggtttaacatccaagcgccggaccgttgcttccgtctgcgtgctcagaaacccggtcaggccatcgaacggtccgccaatcgtcacgattttattcaacgttggtaagcgtttgtcatgcccatacttcaatgcctgattgacaatatcattggccccgagggaatgaccaaccgcattataagctttgacgccatacttcgcttttagttggactaagacttggtgtaaccaataaatctgggctttttgtgaagcgtgattatcttgaaaaacaacttgaaccatcggattcttgattgacttttgccaataacccttaaaggccatcacaccattcttgtacacgtgcaccactaacgctttttgggcagcccccgctttttcggctttacgaatcagatagttcgtcgaatacgccccaccattgtagccatgtaaaaagaccgtcgctgtctttgactggtcatattgattctttaatattcgtgcagaacgcggtgtcaattgactcgttactttcgtaatcttggtatcatgattccgggccccaactaaaatcacagccgcaccgataacaaaaacaatcaataacaattgaatcaccgttcgccaacgtttcatcaaaattatcttacccttcattatgtttaacagtcttattttacgcgtttcaattaaaataaccagtcatcgttttcaacaatcgcctttttaacccgcaccaacgaatattgaacccaaatcatattctttagccccccatctcgttataatggacttactaggttaaataactaacctactcaaattgtttatttctggagggtaactatggaaaaaccaacgtttaaatatcctgataaggctgcgtatgagttcgtcattcaagccttagccgcaaaagggattacttatcatgaaattgcgcatatcacttataacttacaaacaaaatacgtccctaacttaacgatcgaagagtgcgaaatggagacgcaagaagtactgcacaagcgcgaactattgaacaatgcgatggttgcgttagaactcgaccgccttgccacagaaggccagctaaacgagccgctccaatctatcattgccagtgacgccggcgtcttcggtgttgatgaaggcttagcacttaatatggcgaatatttacggcaccatcggcgtcactaattatggttacgtggataaagttaaagaaggcgtcattaagaagttagatactgataagtcaggcgttgttaacacgtttattgatgacctagttggtgcgatcgcggcggccgttgcggctaaaattgcacataagtatgcctaagcattgtatttgctagtcgttatcgcttataaaaatcagcaggcatcctacttcaatgcctgtttgcttgaattagctagtctgtactggatatgtccgctaaaaaacagttacctcaaaatgaggtaactgtttttttgttgaccatgctcaccactgaattaacccacaactgtcaaatgacatgtctactcctcgacctaactactgtaactgatccgcataatctcgtaagtaagttgtcatcgtatgcggagcgtgacccagcactttttcagccgtatcggtcacgcgtttagcgttgcccaactgggtaatcaaatacagcattaccataacattaacatagtccttcttgattccccgcttcaacatcacgcggcgaaaccgccataagctcggtcgatgatacgttaccgggtgaccaaaggattcagtcattagcgccgcaatttgctgataagtcaacgtttctggaccagtcacagtcaatttctgttgtaaatattgtgtatctagtaacgccacgcccgcaatctcaccaatatcacgtgtatcaataaaactcgtcttcgaccgcccggctgggataaacaaatcgtgattttgctgaatgtcgacgcgatgcgtggtattcaaattttgcataaagaagctcggtcgaatgaatgtgtacggtaactgtaactgttcgatcatctgctcgatttgatgatgtggcgtcattggattatgctcaacacccatcaacgaaacaaatacgacctgctcaatgtggtgtgcttgtaagcattttaggaagggccacatatcttgcttgggtttagcaagttgtggtggccgcacgaaaaaaaccttttggattccccgtaacgccgcatcaaaggtcgtctcgtctaaaaaatcaaaacgtcgaatttcgacgttcggatacgcagccaatagttgctcgtctttatgtaagttgtgggcaccagcaacaacttgcacccccacctgttgatctagatattgaattaacggtaagccaatatttcccgtcccacctatcaccagtattttcattttattaattgctccctagtttttttaacagttgtcttaaagactgtttttcagcagccgtcaatttctgaagccccgtcgcaacgacctgattgctaatacgctggccggcctgcaattcttgtatgccaacttgggtcaagcgtagtagctttgctcgctgatccgctggattaacgtcctgttcaaccaattgcttggcagctaagcgtcgaagaattcctgacatcgtcggccggtccatatcgagaacgtggcacagctggttggcagtcggctgttgcgccgttctttcgacccaaagactgatttgttgcatcacagcccattgttgaatcgtcaatccgttagcaattagccgttgatttagctgataacgtaactgtttggaaaactgcattagtaaataaccaatattatccatttcatcctccgctatttagttagtatactaactaaatagctataatttgtcaatttacacacaaaacagtaccgcttaactgtgccaatcagtttatgttggcaagtaagtagtactgttttataatgtttcgccccaaaaacacggcatcaactcataagccgatcatcttaagccatctgatgttctgacattgcttgcatcttgagtacgcgctgttcacgtggaataaacatccgaatctcatcttggttaaagccgcacagaagtcggtgatcgtcaaaaataattggccgccgcaataattgcggtgtttggcttaatacccgaacagcttcgcttaatggcatatcttcaatcggtgtcgtcttactcagttggtgataagcattggacttagtactgatcaaatcatcaatgccattgtacgtgtactgtagcaggtgcttgatttcagtctccgttaacggctgtgcattcatattacgttcatgaaacgggatccggtgttcgagtaaccaccggtgggccttgcgacaacttgcggtacttggtaacacacataagtttatcataaaattatccccaatcttgcttgcctaacaatgcagcccccattattgtgcactgtaatagttgacgtcattaattaacaacataatcatagcaaaattcgcagctaattgctagcgttttcaaaaaataattaaaataatttgatgggcgcagtttattgcaggcctaatcccaatttcatctataccaatattacgcaatttatattaagcggttggtaattgaccactatccttcaggtaatcacgcagtaccactgcctgattatgttgttcgtccttggcaccgaacaataagatcacattcgtcttcgtcagttgttcagcaacttgactaataaagctggccgtcaggggattctcatccaattcagcccggtaacgctcgacaaattcgggatatttcgccggttcatgattgaaccacttacgtaacgtggtcgacgggccaatttcctttacccaattgtccaactgagcgttaaccttcgaaataccccggggccacaagcgatctaccaacacccgataaccatccgtatcaactggtttcgtgtaaatccgttctaattttaattgcataatgaacactcctcctatcgtacgctgcggtaaacaatctatgaccatttacaataacctatcacatttcatgaccataagttgactccattataacgcaggtgccggtatcgttaaatcgaaccaacactttcccgcaaccacatattgatcagtcctcatgacagccactatcatcaattcagtacaaaaaaaatcaggttccacgaatggccctgattttcatcacaatgagttgactaacatcttatcatgattatgacaatcacgttagccttcaccgatcacaacttcaacttggccccttttcggcacaaaattaatgttataaatcggttcccgcaataccttttcatattcttctaagacatcttgtggcaatggcgtatgggcggccaatgcgcgcattaagtcatcgaccgaataaacatcttccatgttaataaagatacgcatatttcccacaacatcattcaataattctgtcaaaatcgcattgggcttaccgttaccatctgtaacaaccacttgattactgtcgacttctttatggtctatctttgttaacttaacgatatcaaatacatttaacatgcgcgaccctccgtcacaatattgatttgctatattctaccacaaccatagcacatctggagggtgaaaagtatttaatgttgactgaattaatcaattgaatagcgtgcaaaaattttttcttgaaccttaggcattggaagtttctgccgctcaatcaacgtaaaggtctgaccagcaaagtaggctaagtcacttaacccaacttgaccactcaaaccttgaatggtccacttctgatgcgtaaacgtatgggtcacaggccgcccggtcagataatgggccgttagctggagctgatattcacgtttaaaataattttctaccgccgtaactagttcttcaggttggtaatcatcatctaagtctaaatctgcaatcggaatcaagggaaccgtccataaattagccaacatcccgttactcggtcgcttcgtcatcaaccactgatcctgcatcttagctaataccgccacgtaagcaaccggcttgggccgcggtttcttcgtcttgaccggataggctaactcatccccatccaaataagcctgattaaagcgtttgaccggcgaatgggccgtatctggttgccgcgctgtcatgtagcttgaaccgaggtccataatcgcctggttaaaatctccaggtcgctcttgtgaaataatctgactgattacccgttcaaaaacagcgcgggtctggggcttcgcaatatccgcatcaatcttgagtaaccggctaaagacgcgataggcattaccatccacagctggaactggttcattgaacgcaatgctggcaatcgctcctgcagtgtacgggccaatcccaatcaactccgtcagctcagcggcagtttgaggccactgtccatcgtaatcggttaacaattgtttggcacaccgttgcatattgcggacacgtgaataataacccaggccctcccacgcctttaacaactgtgactcaggtgcggcagctaggtccgctaccgttggaaaaagtgccataaagcgctgataataaggaatcacagtttgaacctgcgtctgctgtaacataatttcagagacccagacgtggtaaggctcatggtcatgtcgccatggtaaatcgcggccttcgtgatcaaaccaatctaatagcgtcgtctgaaaatctttaattgttgccgcatcccattcaatcattactaaccctccaaaaaaggccacgaggcttcgtctatccgaagttcgtgaccaccttatttacaaattaatccaaagtgttagccaaatctacgagtgttttttcgtagtgatccgtcacactttcatcctggaaatcggcattgaaaacggccaatgtcaaatactcggggtattttaagatgaccgctgccagccgcttattaatatctggatatttttgatcttcattattcaaaatatccagactcgcttggtaacaaacattggctaaaaacaaataatccacaaaataattaaatcctggttcgttttttaattcaaaatgcgccttcacgtccactgtttccgaaatattcgttaaatacttcgttacaatttcttgatactgacgtaacaactccgcctttgcttctgcatgtaccgttgccataaaatatccccacctaatttaatctctgtgaagattatagcatacggcgtaacccctgctgaatgttagctgctaatccagctaactgatcgtactgccactgacgctcggcagtgaccgcaaccatgtcatttggttgcgttaaattaaccaatttaattgcttggtccgaggcccgcagcgcattttcatccgcatctgcggaagctacggcccagcgaacgcagtccagtgccgccgcaccaatggaactcgtcgtcgttgcacttaacttagtcaatcgtgccagtgcctgccgtacctggtagccactaacaagattaacttgccacaattcattagcatcaattgcgagtcgcaattgtcgatcatatttctgttggttatcaacatactgcaaggctttcttggcgataattaacgcccatttagccaattgttgttgtgagagttcaccagtcaaagcttcgatttgagcccgtattccagggtcatcgtcaatctcaatcttagggtgactcggtctaaaaccttccgtcatcacgcattcctactttcttacaaatccgacaacaaacatatcctatcattatcaatattcagttcaattgatatatcgataggattaaattgtaccagaaatccagcaaagatgtgagtatctgactccagatttcatcaaaaatttacaaatttttgtaaccgtttcatccgctataaatacaataaaaagacgccctaccaccaatcgcggcaagtcgtcatataaaccattactgaatttcaatatgatgggtatccgcagctgccttctttggcaaagttaactgcaacacaccattttcatatcgtgcttcgatcttgtcaacatcaacgtcgggtaaagaatattgccggccaaagcgaccagtttgacgttcactcgcgataatattaccatctttatcgctttcatcactaatactatcgcgttttacagcaatcgataatgtgccatcccgatacttcaaggcaatattctgtttatcgattccaggaatatcgactttcatcgtgtactgatcgtcattttctttaatatcagtctttaggaccgacccatgactaccagcatttaagaatgtccgaccgaatccattaaccaaatcgtccatcttagtccagtcattcaaccgatcaaataaatcattgtgccaattcatcatatcgttagccattatgaaatcaccctttcaatttgtttacatcattaataataagcactttcatcaagattgcaacaatttagcactctccgtatcagagtgctaaatcactccacttgatatgcccgcatatcaactgggatcaccctgaccattttatgtggcgtgattgttagttgctgggtcgtcatcttcgtaggccagcgagactgcgggcgatcagctaattccaaaccgaccaacattctgattcgatccagaatatcaggcaccccaaatacattattaccctgattaaatgaagtttggagcatattaatggcaacctgtaagcgctgattatggaagctaaaggttactggcacgtacaccagatcagtagacgataattgctcttgtgccaacgtcttatcaagctgcgccataaacgctgtaaattgatccatttgcgtcacccccatcattaattaccgctattatactgcaagactgatgtgacagctattcaaatggatggctgtcatagcattgctaacaaccgaccatcagtctccgtgccaactgcaattttgctcgaaccagtcaatcatcaccaggcgatcccgtgcactcattttggacaaaataaaagggcgcgaccaatgtctcgccctaactgaagaatcacgctaattattagttattagataactttttagcatcttcatcgatcgtttcgaaaccggaaacgccactcttcttctttggatgctttgcacgttcttcttcggctttttgaatcatagcctttttttgttccttgctaagcttttgtgccatgattatcgcctcttttatcttggacagcgaagtacaacttcgctacatgttcattataagtctaaattcaaaaagtggcacaaatttgcttaacttttttgaaactgcttacttgaattctgtaataattaagtttacagttaagatgttcaggaggggattatatgacaaatgtattgatcttaggggctgcgggccaaattgctcgtttagccgaacagcaatttttagccaacacaactgataatttgacactttacttacgtaatagtagccgggtcgcagaccaacaatctgaccgggtgacgattatcgatggtgatacgactgatgaagccaaattaacccaggcgatgacgggacaagatgtcgtttatgctaatttggctggtcaaaacatcaagcagcaggctgaaaccgtgttaaaagccatgcataccagcggcctcaaacggctcatttggatctcaactttagggatctatgacgaagttcccggcaagttcggtcaatggaacaacgcaacgttgggtagttacctgacgcgctactacgccgcggctgaagtcctagaaaattccgatctcgactacacaatcattcgccctgcgtggttgactaataaggacgaaatcgactacgaaataacccagcgacacgatccgtttaagggaactgaagtttctcgtaagagcattgcggcactcgtcgttaaattaacccaagatcccacaagtaacattcgcacgtctttaggtgttaacaaacctaatactgatggtgacaagcctgcttggtattaattaccaagctggtaaaaaccaatttaaaaatcgactagaatcaccacaatcggcaatgcgtggtggttcttttattatccatcaaattatgagaaaaatgataatatctagacagttaactaacgatgactgacaatcaagctatcaattcactggtataaccagcaatccgttctcatgtttttttcatcaaaagtaatacctgtaaccattgataaatcgcgggtctttgcaattgacggtcaaaaatacaagtgttaaattatagactcaatttgaaaataactggcgatattcttcagttttcaaggaggctttcacttgaatttgaaatggtacgttaagcaatttaatggtctaaccaccacccaactgcacgatatttatcaacttcgtgccaagacctttattaaagaacaagatcggtcttaccaagaccctgatgatactgacttggacgcgcgtcacgtcttcgcctacgatcaggggcaactcgtcgcttatgcacgaatttacgaacatgctggggtcgtttcgttcggccggataacgactgacagttgctatcgtgggacgggccttggcaagcaactcatgaatcacgtcatggcaattcttaaagtgcattacagcgccgccaccattgaaatcgatgcccaaacgcacgcccagaagttttacgagaagttcggattgattgcggaaggtcagccttatattgacctgggtgccgaagttattaaaatgcacgcccccgcccggaaactggtgttggcgtagcacaacttaccaaccatcgtcccccaagataactttaatctactcaaattatgattaaagctgcgcatcagaatgttaaaattctgacacgcagcttttatttttggtcatttcacaaatggtcaagtcctgctgagcccttattcaagggccctaactaaacaaaaatgataactatcattacaactaatcactagccggatcactccgatactgctgcaagatataaatcgcgacaatcaccaataacgagccgaggatttcgacccatgtcacttgtaagcctaagaaaataatacttagtacaaaagtcactactggttggacggcatcaacaatactgaccaccgcagacggcgcgtactgtagactatgtagcaacgataagaaagcaaaaatcgtcccgattaaaacgatggcgccaattgaagtcactagcgttggtgtaatttttggtgcaccgatccaaattgggtgatataaattaaataggattcccgcaatcaatgtcccccaaccaagaatcacgaccggtgaattttcggctacaatctttcgcggcaagactacgtacaaggccgctgttacccccgaaaggattccccagacgagtgcatccatcggaatcgccaactcatgaatgttacccttagtgattgctaaaaacacccccaacaaggagaccgcaaacgcaattaaatcagttcgtaaaggcagttcccgtttaaacagcaacgttcctagtacaataaacaaaggacttaagtattgtaaaatagtggcggcagcggctgttccgcgctcaatactgatgtaaaaagtatacatattcgccatcaatcccactgtcgcgtatgccactaattgtccaaccgacgcccaagatctaaagactttgaagattttggtaccctgttgcacaaatccaatcgctaacagaatgattccagcagataacgtccttacagataagaaccaatcagccgggatggcttggttttgtgatacgaactgcatcactgtacctgagactccccacagggtcgaggccaacatcgcccacatgatgcccttcatataacggttagttgtcatatttttcaatttcgctctacctcaatttaattaatggcaatattataccgagacttaattaaaactcactgaaaatcgagcgttgttttttaggaagattcagtaatctttatcataatcaagttctatcatctataagcaacgataaatccgaacttttattactcattgtgcgcaattacacggaaaccgccctcaactaaatagcactggggcaggtaactacagtaattgcccgccccagtgctatttaagttcgtaccgatcctaacaatttgcgcccatactgatgccgtttccagcacaccgtacttcaagtgccgtttggttagctattgtttcactgttgacaatccctagtccgaactgaccaggacagaagtacttaaaagagcgtcccaacgtagtagtgaatgaacatcgtcacgatcccaacgagcacgttgcgaatcaccgccgtcttcacattgcccttacctaatacggccgataaatatcctgttaaggccacggcaacggacaccgcgataattgttgccggccactgccaatgagccggtgcaaacgtcatcgcgagcaacgggaagacgcctcctgctgacgctgagaatagcgatgcaaacgctgcatcccaaggattcatatagtgtcctagttgcatatcatatttgatgctgacaacggttgccaatggttttttagttaataaatcgcgtgcaatcgccatcgccgtctcttccgtcacgccaagagtcatatagtggcgttgaacagcatgcaattcaccctcaaaatccgtcttcagcaattgccgctccttttcaaccacggctttttcagtgtccttctgcgtgctgaccgaagcatattctcctgacgccatcgaaaaagcacaggctaataaatcagataatccagcaataaaaatcgtgaactgattagtcgtggcggccgccacactaaacagcacccccacaacggttaaaataccatcattagaacctaaaacacctgctcgtaatgagtttaacttctcatccatcgtttgtttggtcttctcagactttgtccttgtcagttgcataagctcgctccccttgaccctttaattaagcaaataagtgaccaataaagtacgttacgatcatcgtcaataacccggcaacgacgttacgaaccattccacgccgacgattagcattacccagcatcgccgctacgtatcccgtaatcattaatgcaattccgacagccaacaccgttgctaacaccttcacccgtggtgggaaaaaggtgatcgaaactaatggcaaaattgagccagtgggaaaagcaatcatcgacgcaataccagccgcatacggactgatgaactggttcggattgaaaccatagcgctcacgcaccgtcgtagtcagcgcatcttccgccatcatttcccgggttgcttgttgcgccaacggtttactgattccttgattgacatatttttgtacgactagcgacgcttctgcttcataatcatcggcaagtgctgccttctgcttagtaatcgccattttttgtgaatctttttgcgtattcacggagacgtattcacccatggccattgaaatcgtcccagccaacatcccggctagtccagatattaaaatcgaaaaactattggtggttgcccccgcaacgccaacaacaatgccggcaactgatagaattccatcattcgctcccatgacacttgctcgcaaaatattaacccgctgtgccaaagacatcctttttttcatgtttgccgcctccgtaaatactttataatcattattacctagtaaatattatatctttcagaaagaaaatgcaaggcttatttgtaatcattatcgagtataagttatgtatccctaaactataatatagtgtaccaccatttaattattaaagttaatttgaataattattataggtcattgaaagtgctattctgcctagaatcaaaaaaagcagcaccgttagcataaaatgctaacggtgctgctttcatattttgaccctaatatattccaacttagtttgctaaccggaactgttgggttgtctttaattcaaattcagtcggttgcgcggccgtcattaaagctggtgtcaattcgacccgcgtaatcgtctgatccgcgtatggttgcatgtaaaatgctggttcattcatgctcatataggcgcggtactgggtataatctggcgtcccgttatcttgcatcttaacgcccttaggaatctccactgagttcagcatgtgtgataatgcgttgacagcttctgcatcagtcgttactgcatccgtatgttcacgcatgaagaccgtccgaacgaagcgtgcaactgacgtatagtcaccaggcattcccaacgccccagttccaggaccgaaaggattcaccgtcatgtcaccgtattgacgactaggatgagggccgggttgtaagttgacgtaattactcaaattcttgagatgccattcaaaatctggtgtgttcgtcatgacgcccaccggattcttcatgtagtgaacaccgtcattttccaattctaagacgtaagtagaaccactcttgtcactaatgatccagtgtagtggtaccacaatattcaatagtggtgcggcggcttccatcacgttcaagtcagcaatccgttcgcctaattcagcagtgctcttcacgtttcctaaaatccacattaaaacttcgtggggtgccaagttaaccttgccagccttagtctgctgagtaaagtgagcttgtcccgagaaatagagtgcagcagcactgaccccgtgctcattgacaccatcgacaaagatatagccatttaagtcacggcccgttccaacaaagctatacgggctatcaaaaccgtccgcattggtaacactgtcaaagtggtgattccgtgggattgccactggtcgaccaccaagttcaaaagcaaagtccatggtgcgtgctaaaaactgatcacccgccgtggtttgaatcgttaaactagtacacatgggtttcacatccttgatttaaatactattattctagcatctaaacccattataaacacacatttgcacaaattaatttacgccaatcagtttaccttagtcttttaatcgtaacgtcatcgcattaattgccacgattaccgtgcttaatgacatcactaccgcaccaaacatcgggttcaaaataaagccgagtggtgcgagaataccagcagccaaggggattgtgatgacattgtatccagcaccccaccataaattttgcgccatcttccgggtcgttcgccgggccagagccaagaaatcgaccacatcatttggattactcttaacgagaacgatatcagcagaatcaatagcaacgtcagtcccagacccaatggcaacgccaatatctgcccgggccagactaggggcatcgttaacaccatcgccaatcatcataacgtggctaccatcagcctgatactgttgaacgagcttagccttatcttcgggcaataaacccgcatgcacttctgtaattccgagctgcttagcaacgacttgggcgctctgcggattatcaccggttagcattactggggtaatgttttgggccttcaaactatcgatcaagttcttggcttccggcttgatctggtcaccctgagcgacaaaacctaagactgtctgctcctgaatcaaaaaactgactgagttaccggcacttgccagtcgattgaacgtttgctggtcataggctaaattttgtttatccaagtaagctgccgaaacgatctgatacgtctgcccatcaatcgtgccgcttaacccgacaccagtaatctgatgaacatcctgactaaccttaggggttaactgatgttccttagcggcagcaagaattccgacagctaagggatgactagagccattttccaaaccggccatcatcgccaagactgcgtccgcagttagccggtcggcgctactttgataatcagcgaccttaaagttaccagctgtcaatgtcccggtcttatccatcaacgcgtagttcaactttttgacttgttccatcgcatcccgattacgaatcagtaacccgtggctggccgcaatcgccgtactccgtgccactaccaatggaattgccaatcctaaagcgtgaggacaagcaatcacgagcactgtcaccgcaattgatagtgctaacgccagattgcccacgagtaaccagacgataaaggcaacgattgcaacggtcaaggcagcgtagaacaagagtccggccactttatccgccatattttcttgcgacgatttggccgcctgtgcgtcactgactaacttcatgacttgggctaagtatccggattcaccagtcccggtgactttcatctcaaacgtcccatcaccattgactgaaccacccacaacttgatccttagcgcgtttttcaactaacttagcttcaccagtaaccatcgcttcattcacactagtcgcaccatttaacactgtgccgtcagctggaatttgttcaccagcccggacctgaacttgatcaccattagctagatcagcaattgccacgtcatggacctgcccatcaactaacttatgtgccgtacttggtaacagttttgctagtttatctaccgccgatcccgcattcatgaccgtattcatctcgatccagtggcctaacaacatgatgacgatcaaagtcgctagttcccagaagaaatcggtcaccattggttttgcatttaacaagtcattggcaaccacagcatagatactgtaaacgtacgccacactgatacccattgtaatcaacgtcatcatggcaggcttatgatttttgacctccgccttggcaccgctgaaaaacggttgcccaccgtatagaaacaggattgtgcctaaaattgcgacgatataatcggaccatggccgaaaaacgatttgaaatggtaaattgacccccatcatcggactcataatgataatcggaatcgtcagaactaacgctacccaaaacttcaacttgagattgcccatgtgcatcatctcaccgttacccatatccatatcgcccatgtcatttgaatcatggtgcgccatgtgttgcatatccatgtctttcataatagcgacctcccctagtcggattgtctacatctgtaattcacggctaaagtttacatttgtagacggtaaaagtcaagaaaaacactttcttgactttttgtcgccattcatctgtttcctgagtatcctatcttgaaagtaagtcccttccattagacgcactataactgatggttccgattaaggcctgcacgaatgccccatgatcagttagccaagtatctttaaaatcattctcctcaaaaaatgtcatgttcagattaagaaaatccaaacatgacactcagtgttacttcaatattcgtttataaccacattaacaccgcgtccccggcacacaatcgcagtccaccatttctggcgcatccttggctttttcagccaatactgcctgtaaggcggcgatatccgtttgactcaattccgtttggttaacaaggtccaccagcgtttgaccaacgcgcatctgacataaatgaccgaagagggtgtccacggcttcatccatcgatggctgttcctcaaccattggataataattgaacgctcgaccattcttttcagcacgtaatgcaccttttttgacgagccgtccaagcagtgtcttgaccgttgctgtcttccatcccatcttatccgccatgatttcagcgacctgactactcgtgacattgcccaacgtccaagcaacccgcatgacttcccattcggcatcactgatttcaattttagtttgtgcttccaatggtttgaccacccttcgaattaaattaactgtagtttacaaccgtaaacgtaaaaaagcaactatcaccctcgcacggttcatcatctagcatagcgcaattttctttctaataacaacattgactgccattaaccactacccaaatcatcactagttaggttaataacttgattggcgcaaaaaaacggccctaattactgagccgcaacaaaatgatctaataatgatgataacgccgcgacgctatctggataattgctcggatgttgtaacaggtaactcttgattttgccgtgatacaataccgtcgtggcggcctgtccgctcgtctgcaataaactccgccgaaattcattgagcaacagttgtaacccgctttgcgctgcgtcttggcgctccaacatcagtgccgcacggctgatagcatcgagaacctgcgtttgcgtgatttgtgattgtgttgacatgtttttccctctatttactgtaatatgcttaagtatacaccgttagtggcacaaacaggtattatttatctgttgaaaaactatgttatgctactaaatattaattattttagtgacgggggttcagcatttgaaaccaaactcaaaactattacagcgactacgatcatggatgcgtgggcggtacggtcaaaacgatacgttaaaccgctttttaaacaatctcgctttactattgatcgtcatcagttttttcattcgcaccgggtggctactcttaattgccgtgatgctcatcggtattagttactggcgtttgttctctaaaaagatttatcagcaagttgcgatcaatcgcggctttcagcgcttttggtcaccgattattcgcccattcagccgtttaaaataccaggtcaagcagcattggcaataccgctttttccgctgttcacagtgtcaccaacggattcggattccgcgtcatcatggtcgcgttcggataacttgcccccaatgtggacaccaattcgaagctaaagtgtaaccatcgtgcttggatgaaaacataacgattgttgaacataactgatccgcctgcagacctgattttgcttagcaaccacctataataggccaccttagtttgacactgaggtggcctatttacatacaaaaacactattttaacaaccattacgtgctacctttctcgctcaatgaaactgccgacaattgcagtcacagacgtactagttgagtgatggttttcaaactaccgtaaatcaatcctcttttttcagaaaaaacacttacgaaaaaaataattttctggtatgctaacccattgtattcaggaaagtgagtgtgaacaatataatggattcagtacaaagtagcccgcaagctaaacaacgggcccgcgttcccgttgcccatcccatgctagccatgatggggatgttaattggtggttttgttgggatgtttagtgaaacatcactgaacattgccctcccccaattgatggctcagctacacgtgtcaacggcaactgtgcaatggctagtaaccggttacatgcttatgattgggattgtccttccactttcaagcttaattaccaaatggtttacgacccgccaagtgattttatttgccctgattgacttcgccgttggtgcgattatttcggcttcagcgcctggctttggcgtgttattattcggtcgaatgattcaaggtatcgcaactggcctgatcttaccactcatgtttaccgtggctatgcagatttttccaccctacaaattaggggcagctatggggatggtcggtttagtcatcatgttcgcaccggccgtgggtccaacgattgctggagccatcttaggactagcttcatggcggtggattttttggctctttatcccattcttgattattgcctttatctttgccgtcacttcacttaaaaacattgcgaaagtaacccggccgaaagtggacttcttatccattttactttcaatggttggctttggtagccttgttgttggcgttagtcttgctagtgatcaaggttgggggtcgcccgctgtactaggtgccttaattttgggactggttattctggcttggtatgcccatcgacaactcaccatggaatcgccaattctgaaccttaagacatttgctatccctggttttcgggttggcgcttgcctcgttatgattaactttgggattatcttatcagccatgtatttactcccaatgtacattcaaaaggggctgttgattcccgttgccttgactggggtcatcatgttacccggtggcttgatgaacgcaattgtatcggccgtctcgggtcgcttatatgactcgattggcgcccgcactccagcaatgctggggttcttgatttcaatggttggtgccctcatgttggcactgacaaccacgcagagtgcaacgtggtacgttattttggcccacgttatcttaatgattggggcgccattagcgatgtccccttcacagacgcatggtttaaattccttaacgggaccaattgccgccgatggtagtacaatcatgaacacactacagcaagtcgttggtgccatttcaaccgcaattgcaacgagcttattaggcattggccaagcttcttactacgccaatgggggtcatcaagcttctagcgcgttcgtcaacggtgcccattacgggttctactttacgtttattttagcgctcgccggtttgttgcttgcaacccgtttgtctaaaaaaacgactaactaactgtcattaatcaaaactagcgctgttaatcataagcagcctagtttttttattttacgatcgattatcattgaagtagtcttgggtggcttctcatcagcaagccacccaagactactcagtcaccatgcaatgcttagcgttcttaccacactaagaatcctgataaataattgcactttatcgcattttaatgcacaattaaaatgataatatgaggagtcgaaagtaatttatggaattgacaattggtttaattattggcaccagcatcattcttgccatactgtgtggcatactcagtatttactactatcaccacaccaaaaagctgaacggtacgatctgggcactcattggtattgcgctattgtgcctggctggcttttttgtttgggtcgtctggtttgggttataaactaaactgcggctcaccgttactagtaaccaatccgaggaggaattgctcatgaacccagaagacatgtttcaacgttatctcaacaaatatcagattacgtatcaacatcctgaacatggtctagttatgctgacctcccctgtctggccccaacatcccgagctccagcaggccattcaaagcgcttttcaaggcctaaacggcgtcactagtattacaatcaatagtcccgaacaattagtcatgcgctatcactctgatcagttacggcggctaagtccgttgactttacttagcttagaacgccagttaagcaagcaatatcatcaagctggctattaaacttaatggaacgcaaaaatgcaggctacccggttaaaagtggatagtctgcattttttcactttattattgatttagaatgttacagctgccattattttaccttcatcgccgctaaaatcgacaatgtggcgttttaagttagcagtccaagcttgacacccagccttggcaaactgcttgacagcgtctgttagagccagctggccagcaatatattgcttcgcgatttgttcaactgccgcggcatcttcttcacgagcgacccggactgctaagccattcgtccgccgttccacgagataaccgttctcaccaaagtaagttgtggcacccgttgcaacatcatattgaaaatgttgaacgcccaaatcggcttcttttttggcaatcgtcgcaaagtccgcgtggtcacctaaattatttaatacgtcatcgatctcagttaatttaaacatcatgacacccctcgttctaatttcgtttacttatctattgtaatccaattagacacgtttggcaggtaacgggtagaaaattcgcattaaagccacgtaaatgaccccgataagcgccatgtcaatgaaggttgcaccagtcaccgtcgcaatccaaacaacgtgcttcaataacaagaagatggccacacctagtacccaacataatagcgcaatccagttcaccccatgatgataccaatactgccccttagagctcgccagttcgttgatatcatagtgctgacgatgccgccaatagtaatcgactaacatcacgctgatcatcggtccaagcaccatcccaatataatctaggaacgccgtgaatgcagctaaaaaactccccatgattaatggaatcagtgtgactaacgtggcaatgattgtcacggcccacagtgctggtcgtaaccgaatccgtgggaagatattcgacagcgccgaaccagccgccaataagtttaccgcgttcgccgtcatactcgttaagacaatcaccagtagtgctaatacccccaagcctagtcgactcgcaatggtactcgggtcagagttattaggatcataagttccagaagtaatcgcgatactgatcgtcgcggcaagcccgataaaggcgaaccagaacaagccggtaaaggcccctaaaaatggcatgccagtcgcgccactctttttgcgcgtaaaccgcgtaaaatcagcacccgctgtcacccaagacaaattgaacgccgctagcgtatccatcccagcccccgccgtcatatgtaaatgtgtcggcgcctgccacgttaacaattcatgcactgagaccgtctggaacacgacgaccgtctcccataaaacaaataagatgacaagaataatacctaaacgttcaatcatctgaaccgaccgttgaccgaccgaaacactcaataaatgcaacacactcatgacaataattccgaggatcagtcctttagccccaccgggtttaccatagactggccagccaactagatcgtgtaataaatagctgacagaagttgctgcaatgaacgtgtttaccgctgtccagccaatatactgggtcaagttcacaaaggacggaacgtaactgccccgcacaccaaaggaaccacgaatcaagctcatcgtcgccgccccggtcttataccccatgaagccgactaacgataaacataaatacgatagcgtggacgatgctacaatcactttaagcgccgtcaataaaccacacgcagccaatacaccaccaacgtaccacgtgccattattggcattggcgccaatccaagttgcaaacatgtcccaattagacatgtgtcggtgcttaggcgccaccacttctatttgatactttgactcttgctgcacatcgttcaccctttctacaatgttttccattgtagtttttttagtgacgcttggtcaagtctatttaactaagttagttaattgcacaaaacttaaattcgcattaaaataatcttaataagttaattaaggaagtgacagattgtgaagggcgcattgacaggctggcgccggaatctcgctgttctctggctaggaacatttatcgccggaatgggattttctgaagtcatgccattcttatcattatacgttggtcaaatggggggatttctccaaaaacgaactcacgatgtatagtggtattacatacgcagtgactttttttgtcgtcgctgttgtctcaccattatggggtaaactcgctgaccggcgtggtcgcaaaatcatgctgctgcgttcttcgcttgggatggcctttgttatcggtgcgatgggatttgtccataacatttggatactcattctacttcggttcttacaaggcctgtgtgccggctacattcccaatgctagcgccctaatcgccaccgaaactcccaaggaaagtagtgggaccgcaatcggtatcctaacaactggctacgtgtctggtaacttgatcggcccgattctcggtggcgtactcgcccaagttttctctattcgtttgactttcattatcaccggaattttgctactgatcgtcttcgtattgagtctgacactcgtccacgaaagctttaaacccagcgacgcgccgattgctaaacgtgacggcagtctactcagccaatttaaaaatccaacgttgattatcacactgctcgtctccacgatgattattcaaatggggaataattccatcacgcccattattagtctatatgtcaaagaactgatgcataacgtcggcccaatcaccgtcgttgctggaatcattgccgctctacccggaatttcgacgctattatcggcgccgcgactcggacggctcggtgatcaccggggggctgaccgtatccttgtctttggtttcgtctttgccatcctgatgtactttccgcaaggcttcgtctccagtgtgtggacattagggctattgcgcttcatgattgggatctctgacggggccctctttccaacggtgcaaacattattatccaaaaacacaccccgcgagttaacaggcactattttcagttggaatcaatctttccaagcggctggcagcatgctcggctccttacttggtggcgccgtctccggctggttcgattacaacggtgtctttatcttcaccgccttgtcattactgcttaacttcatcggcgtactgatctttattccaagtatgcggcacccatttgcaaaacactcggttgattaaccgcgctatttatcaagttcaaaagctatcagcttagtcccggagatcggaccaggacgcggaccggctgacaaacactaatccgactagcatattttaaccataataaaggtcaccaatcagcaatcgctgcttggtgacctttattagttattctattccgttagctcttacttcaaatattttgccatgaactggcttactttttgttgatatagttgcggataacgcgtgtatgattccgcgtgaccagctcctggagccacccataattgctttgacttgaccgtcgtagcgcggtagttctgatataccatcttcgtggggacaaaagtatccttagcaccatgaataaagaagattggcaacttattcttcttgagctggtttactgaactcgccgtcataaagttgaagtgggccttcgcttgagctacccagcttgccgtatacagcagtggaaacttcggtaagtgatatagttgattcaactcatatcccaattcatcaccaacactggtatagccacaatcttcaataatcgctttaacttgtgatggaagtttctcgccactcatcatcatgacagtcgcaccacccattgaaacgccaaagagtccaatctgactattttggcctacgcggcgaatcacctgtcgcgtccactttagatagtccaaccggtcaggccaaccaaaaccatagtaatccccctgactctgaccattgccacgatcatccggcgccagcacattatatccttggcgatgccacaatcgaatatagctcgccatctgctccttgttacccatgtaaccatgcgccacaataatcgttttggtggttcggtgcgcagctggtacatagtccgcaactaacttcaaatgatccgttgcggacgtctcatgccaggtctgcttgttgacccgtttcagccacgcttggttctgcttcaacttacttttactcttactagaactatggttcaaaactttcggggtgggttcaaatgcaaagtgatataaataaaaactaccgcccgcgaccccaatgacgatcacggtcaagaatgcaatgagcgcaattgtccattttttgcgtgttgtcatattctctttctctctttcatacctaatcatatctgctaagcctaattcgctttaattcgaatacgctacaagcagccatagcgatattatcaaacgctattctcaattatgtgcctatctcaactcaatctaccaattcgttaagcgctcggatcgttaataaatgtgccgccaccgtttgagctgctaattgaattgcccgtgctaacgggtcaaccgtcgacaagacgaccggttgtccagcaagcgtagactcgaatgcttgccgaaattgctggtaccgcggctcaatctgacgcgaatcacgaatttgcaaaatcgctttactaattactggtaatgaaaaatcagtcttcaaaattgaaacgactagtaccgccacaatctgattccgggtataccgatgtccaaccggccgactgaaaaaatgttgtttcacgtaactattaatcatcgtcttcgttacggcaggtaaccccagcggctgaattgtttcattaacaagttgcaacaactgttccatataaacgggcaccgcgggcaactcttcccacgaaagtaaatagttactagttgatccaaattcctccatcatccaatcctcctcactaccctatttaatttagcccaatttagattttaattcaacaatatctaatcatcaccttgttataaatagaattataatctatatatccactctgctaattattattcgcttcaaaaattattaaaagatgcttattttgaaagttcaaaaatagccagcttaggcccgctggaaaaagttcgaatcagcgtaaacatgcttggttggttcgtcctacaccgacttccaggcatttctgccaattgccggaacgtggtgggcacagatttgagccgaaaaatcacgtctcaaatactggcctttcactaaacaagcacaggacgcttgctaagtgaaatttcaccactgggcattgtcagaaacgccttccagtcgggagagtattcgaatggcagacgaagctgtacttaacttttgatgaatttgccgttgcttttcgtaaacggtaattttgttaatcaactgtcaaactgaaaatgatattgaggtagctcattaattctgaatcggcatagtaagattcaaactcctgacagagtgcctagtgcaccctaaccctttgtctttgtttaatatcaaaatagtcaacgataaattgtgctaagttaagtggccgttcatcagccattcgagcggcttaccgaaacgtgttcggtgccactaaatcctgtgcttgctacgccaatggactaatgccaaaccgcattaatccgttggctaggcaatgctcggcttcaacccgtagcccctcgcaagcttgagactggaggggctgggtgacaatgctcagtagccaaattattcttagtcggaagtggtctgcttccggcttagaataagactcgtatttgagaccgggcgggttgtgcacgggctcaaatacgagtcttacgttccagcaattgtcacccagccccggaggtcggaataggacgatcattgctgacgaacagcaatccaaaaataagcaccttttaataatgattcacgccaaatcaaggcttgaaagccaccccatatttccgctaaaataggcttatccaaattttgttatccagaaaggaaatcattatgaataacgtttacctagctgcaccgttttttgacgaggctcagaaggaacgcatccaacaagtgaagtcggcgctgttggctaacccgacgatcaaccccgatggtatcttcatcccagaagaacatcaatttgaagaagaaccttttggtagccgtgcttggcaacaatacgtctacgcatccgatatgcgtcaagttcatcgggccgatgtcgttgttgccattcttgacttcgacatgactagtgcaaccaatgagccagattctggcacaatgtttgaaatcggtgcggccgtggctgaaaagacacccgtcatcgtcgttcagtttgatgcgaataaagaactcaacttaatgattgcccaaggattaacggcctatttcgatgctagtaaagatggtctgaaagaattatctgcctacaattgtgatgacttacgttctaagcccgctcaccggccagtattttaggcacacaacttaatgacacgaaaaaatgctgcttgcaaacgaataacgtttgtaagcagcattttaactaacttgaattgatcatccttattcagcagtattcacgactaatcgtgactgtcgccgcgcctgccagcgcttattcaattccagcacgaatgttggaatcagcgtagctactagcaccgttaaccagcctaacgctggtagtgtcactaagctaaagaaactacggaacggtggtatcactgcaattgccaagaccaccagaattcctaacagcaatcctcggttcagcattggattacgcatcatgcttgaccagctgagtggtcggcgatccttaattgcatagatgtcgatcattgatcctaatgccaatactagaaagaccatcgtcatcccgactggggcttgaccatttgttaagccaaagcggccaaacgcgtaaattccgagggttagtacggtaaaagtagctgcccggataaacaaccgttgaccaaggccccgagctaaaatactttcgtcatcggatactggtggttgttgcatagcttggggttcacctggctcttggctaataaagaatcctggaatcccatcagcaagtacgttaataatcagcaattgttctgctaacagtggcgccccccaaccgaagaggactgcaccaaccatcaagaagatttgtgcaaagttgacacctaccaagaattcaacggctttaatgatattctgataaactgtccgaccttccttaactgctgccatgatcgtcgcaaaattatcatccgttaacaccatgtcagcggcttctttagatacttcggtacccgtaattcccattgcaatgccaacatccgccgctttcaatgccggcgcatcgttgacaccatcaccggtcatcgcaaccgtcttaccaagactttgccaagcctgaacgattctaattttgtcactcggcgacactcgggcgtacactgcaatctgatcgatttgagccgtcaattcttcatcgctcaattggcgtaactcatcaccgctaattgcttgcagctcaggggttaaaatgccaatttcctcagcgatagccttcgcagtaaccaaatgatctcccgtgatcataactggaaaaatacccgcctgtttggctgctcgaatggccggaatcacttctggtcgtggtggatcaatcaaaccaatcaatcctgccaattggaggtcagctgtcaggtcgtcccagtcagtagtttggacatccgcgggaatgatgcgatagccaacagctaaaacgcgaagcgccgcctgcccaaattcatcatgggccacttgtccagcagctaggctagcttggtcaggcttcagtggtaaccgatcccaagcccctttgacgataactaaccgtcgaccatgcgctaattcatgcaccgtcgtcatcatcttcttagttgagtcaaacgggtcttccgcaattcgtggggtctgcgcctccaagctgggccgatctaaatcatgctgagccagccaacgaataacggctaattccgttgcgtccccaatggcttgttcttcaccgtcaacgtggttaatctcggcattcgtcgctaatcctaagtaacgcatcaatgtttgtcccgctgatggcaagggctgttcggtcgtcataatgcccgtggtcggcgtccaatactttgtaattgtcattcgattttgcgtcaaggttccggtcttgtcagacgcgattacatcgacactcccaatcgtttcaacggcactaactcggcgcatgatggcatttctgtctgccatccgtcgaacaccgtgtgaaagactaatggtcacgatgatcggcagagtctctggcacggccgcgaccgctaatgaaaccccaatcatcaagctatcggccaaaccttggttttgcacccaaacactcagcgcaaaaatcgtaataccacctaagacggcaaatgtcgttaaccagcttgatagccgattaagccgcccctgtaatggcgtggcccgttgcttcgtcttgttcaacaaacctgcaatttgacctaactctgtggccattccggtcgttaagacctgaatcaatgcagtaccggctgtgacggccgttcccgcatacacttgacagttatcatccaactcaccggtgtcctgataaatacttttttcaacagcttcactttcacctgtcaagactgcctcatcaacggctaagttcgtggcctctaacacgaccgcatcggctggaacctggtcacccgcttttagtagcactaaatcaccgggaacgatttctggtgccgcaatcgtttgtaccttcccatcccgtcgaacattagctgtgggtaaactcattgacttcagtgccgccaacgacttttctgcggaagcttcttggtacaaaccaatacagacattaataactaaaatggcgccaatcacaatggtctttgtccagcccccattctgggcaagagccaagtacgtggctaaaccaactgcaaataataacactagcgatgaaacgtcgctcatatgttgccaaattttacgccataacggtacggggcgcgcagctactaattcatttttgccgaatttagttagctgggtcgtcaccgctgtggtcgttaaaccggactcgggggtaggtttgaatggtgcattctgataattctgcatcgtttattcctccgtaattcgattatcgttgtcattcgtcactattaatgatagcggaaacattttgtcgttttacgtgcaaattgtgaaaaagtcgtgaagattagaacgtacaattaaaacagtcattaaacattaaccacaggtcatcatcaaaaaactgttcaatttatgactaaaatcaagttaccagccatgaatattgttataatagaacacaaatattccttggaggcacgttatgaaaatcaaattaatctcaactagtgatgtgcacggttacctcgcgccaactgactacagtcgtcgtgataacatcgcaccatttagtcttagtcgtgccgctactgttattcatcaactgtcacgtgaagatacggctgatgtctggccaatcgtgattgataatggcgactacgtacagggatcaccgttgacctatttcattgctcgccaccaccaagaagctgcaccgttatactcgcgccttgcaaattgcaaccacgttcaagctggtattttcggtaaccatgaattcaactacgggctcgactacctcgacctgtgtgaatcaagccgccaatatccgatgctggccgctaatattcatgatgacctgcaccgcaccttattctccaagccatacacaattctggaacgcgccggagttaaagtggcaattttgggactaacgacgcaattcgttgcccactgggaacaaccacatcacattgccggcctgcactttgaggacgtggttgcaactgctaaacattgggtgcccaaattgcgccaactggctgacgtcgttgtcatcgcctaccacggtggtcttgaacgcgatccccaaactgatcgtccaaccgaacgcatgaatggtgaaaaccgaggttccgcactattagctgaagtccccggcattgatgccatgattactggccaccagcatcgacaattagccgttacggttcacggtgttcccgtgacacaacctggtatgaaaggtactaatgttgctatgattacccttgagctcgaccgcaatcatcaagtgacgaccagtcatccggaaatctatccggtcgcagatgccacccccaatacccaggtaatgcaactagttggaccaatcaatgaccagatggaagactggttagacacaccacttggccaaattaacggcaatatgctcgtacacgatcatcttcaagcacggctgcataatcatccttacatcgattttattaatcgcgttgaaatggccgcaaccggtaccgatattgccgcaacggcattatttaatgacgacgtaccaggcctcaaacaacacgtgacgatgcgggaagtcatgaacagttacgtctacccaaacaaacttgccgttgaagccattactggtgctgatttacgcgccgctcttgaacgttgcgcgagttactttctcctccaagacggacacgttcgggtcaatcccgagttcatgcaccctaagttgcgccactatgtctatgatatttacagtggcatcgactatactttcgaccttaccaaaccctttggtcaacgtgtcgttcaactcgattatcatggggccccagtcaccgctgaccaaaaattaacggtcactctgaatcattaccgcgctggtggcggtgggaattacccaatgtatcaaacagctaagattatccggcgcttacctactgatatgaccgtattaattgccgactactttgcgcaacatcccgtcgtcaacgcaacgcaaccgactaattttcaagttcactattaagactaacgcgacaaacccgctcaaatatgcactatttgagcgggtttgtctatactgacgttcacaacgtctggtttagcatcgtcgttaaaccgtgccaattaacctttgtcaatcgggaatcataacagcactgaccgcaagtcgtgccctcctttgtgggcgtctcacaaacccagcatggtaatcaaaaggtgcccgtcatacgagctgcaatccccacattaagaatcccatggtcagcggcgcaatgaccgtacttaacatttgcgtcgccacatactcatctggtgccaagtggttttggacggccaacatggtcgcgatggttgcagtggggattgcgagcgtcaggacgactaattgttggttacttaatgacacacctagactagccataatcccccaaatgagcaccggtaagcctaaatttttcagtagcacgtttaagacaaccatgcgcgtcagtcgccacggtctagtcgttaacagaagtcccagcgcaaataacgccacgcccccagctgcttgtcccaactccgtaaaattcgttagccaagcactgggcaaccgcaatccggccaaatttaagagaaaagcactgattggcgcccacacgactggttgccgactcgcacgacacagtttctgccaaccggctcgccaacgttgctcaggtgtcgaaccgcccgctagcgttaacagcaacacgctcactggcacttgtaccaaattcatgtacaggccgcctaacgcgaccaataaaacactgattttaccaaaaaccaccagtaaaacggaaacacccatgaatggaattgaaggactggcgatcactagcgctcgtaatgtccccgtttctagttgttgatggaaacagcattggctcacaatgacgataaccatgccacctagcatgcctagcgccaaccacagcgctaccgaggagttttgaataatggtagcgcgctttaatgacaagattcctccgaaaagacttaacggcaaggcgtaatgcatgaccaactgaatcaaaatatcactggtcgttggcgcaaattggtgccgtagccccgcaaacacgcctaatcccaccgtcacaacaattggtaaaattgctaatatcagtaacattcacaggcccccagacttaataattaaaactgagtgtaccatagtccaatcgctgtgatagtcaggttgctagtcaacaatcggacatcttatgacgtttcattagtctaattaggggcctacctcatattattaagcggccgcgccacactttttacgataacaacgaattttctaatttaactagctgactccgacaattaggtgattagccaaataaaaaggatgctgccagtggctgcatccttaataacgatgaaacttagaaattaacttgatcaggatcattagctaacccggcaacaccgtggaaaccatcaatgaccttcatatcatcatcgctgagttcgaaatcaaataattccgtattttgttcaatccgatccgcatgaactgattttggtaatggtaagaaaccgtgttgtaatgaccaacgtagcacaacttgggcaacgctcttatcatacttatcagccaacgtctttaattctgggatactgaagatcttaccagtacctaatggactataagcttctgataaaatgtcatgtttgcggttgtaggccacaacttcatcttccatatcactaggattgaggaagatttggttaacggctggcacaaccttggctgtcttaagcagcgcgtctaaatgcttaggacggaagttagaaaccccgatagcccgtgctttacgtgccgtgtaagcttcttccattgcccgccaagtatcggcgttcaattgttcccaattgtcgcgcattgcggctgggtttggccagtggatcaagtagaggtcaacatagtccaaacctaacttagccaacgaggtatccagcgccttcttggcagcgtcatagccatggtcggcattccataatttggtcgtgacaaataggtcttcacgtgccacaccactatcggcaatagctttaccaacactttcctcgttaccataggccgccgccgtgtcaatgtgccggtaccccgcctttaatgcggctaatacggaatcgtaagcaacctgaccatcaggtgtttgccacgttccaaaaccaacaatcggaatcttagtgccgttatttaacgtgtacgtatcggtgagtttagtcaatgcagtcatcaaaaatgcctccaagaatttatttgttaagataattctacccataaccgaccacttccggcaaacattctgttccaaactaatgacgatacgcaaaattcgtgagaaaatataaacattctgatgtgggaggggttttgatgagcgatacggcagttatgttaaaaaccacgttattggccggcgccattttgctagaaaatggggctgaaatcaaacgagttgaagacacgatgcaacgaattgcaaccaacgcgggctaccctgacgcgcaggtcttcgtactgttaacagggattaccgtctccttgccggaaaatgccactagcgaagtgcgagcaatccataatcggggtatggacctcgaaaaagtggatcaggtcaacagcctgtcacggcagtttgctaatcacgatattgatttaactgaatttgccgcagccctcgaacgggtcaatcaagccgtaccgaccttcccattcagctggttatgtctagcggccgttgtcgttagtgtgccgttgatggtcgcctttactgggcggacaactcctgccgacttgatcacttgtgggctagccgggttggctggttttgctgccttttattggatcaatcggctggggtcaattcggtttctcagcgaatttatgggcgcttttattattggtctaattaccctactcggcttttatctcactaacggtcattatcatcccgacgccatcattattggcgctgtgatgccattagtgccgggtgtcgccattactaatgccgtccgtgacacaatgacgggtaacttgctgagtggtcctgcccgcgctgtagaggccgttttatccgcgtgtgcgattggtgttggtatcgcactgacttcatttttctactaaaggaggcgtgacatgctacattggctcttaacaaccggtttatttcaaattatcttagcttacttagctacggctggttttggggtacttctcaatattccgcgtcgcgccgttaacctcagtggttgggtcggtgctgctggctggtttacgtatgagatcctctatcacatcctgccattaggaatcgacgccaaacttgcgattggtaacctcgtcgcagctatcgtgattggcgtcgctagcggtatggccgcacgctacaaacgaatgccgatgatcatctttaatatccctagtctggtcccactggttcctggtggccagtcttatcgagtcgttcgtaacttggtcactggtcaaccagacttggcctaccagtactttgtacaagttgtcattattgctggcgtgattgcaattggctttctcgtcgctgaatttatcaatcgcattactttacactttgtttaatcaggaaaatcagctagtgcatctttgtcggttagcaaaatgacaccacgttatcttgatttgcagctgttagacttcttaaatgattagcaaaaaaatagataacgccctttactaagtacttacaataaaagtaagttaataggtctaatatagttcaaattgtgggcttataagcctgcaacatttacaataataattgtatttaacccgagattttctaacttggagggagaaaagctcaatttattatttagatactgacaaaataagcttagagaaaaagaaaaatactcttggtaagattggcataaaattatgaccttcattaatatttttcaaaactgtaaattcaattaaaatactgcctaattacgattctacagctgcaatttcaatgtgattgcgaagccttaaaaagtagtatacgaggagaatattacaatgaatactaagtctaatcatctcatcgaatggctgctcaccttattattaataatctcaattctgataaatgttggttggtttatttttcgatatggcggtcattactactacatgaaaatatcgagtagtaccggaacttcccccattacactaccggtcaatgtcccagctactgggtatcaataccaaggactagcaactaattctaagggcgaaaaaaagtatcttcattttaatacagttgctgctgatccagccccattcaaacgcggacaaattgtcagaatcacattcaatcaaaggtacggcgtaaccaactataaattagttcatcggtaacacgattacttcaaaaaagccgtcataacgattggtttatcacttatccaatcgttatgacggtccatccattactagaatgatataatctaaaaagtcagcaactaatttatagtcgctgactttatttattcatgatatttgcggcaacaagcttagccaaaagttacgcttctagtatttaatgaatcaacgtaaagtagccaatcacaagtacccccaggacaattcggtaccaaccgaacgccttgaagtcgtttttcttgatgtaatccaacaagaaacgaatcgacaagtaagcgactatgaaggacacgatcaccccaacggctaagactgctccttgcaaaccagctaaagaaccaccgtgagcaaagaatttcacaagcttcagtaatgacgccccaaacattgttggaattgccatgaagaatgaaaactcagttgcgacgtagcgtgaagttccaatcaagatagcccctaaaatggttgcaccggaacgtgaagtccctggaatcaacgagagcaactggaagcacccaatgaacaatgccgtcgtataaggtaacgtttgtagattagcgaagcggggtgttaagcgcttattatgattttcaatcacaatgaataggaccccataaataatcaacgtggcagaaacgaccgcccaattcattaaatgttcgtccatccaatcatttaacggtagccccacgatcactgatggaatgaccgctaataacaccttactccagagaacccaagtatttcgcttttccgtggtatccttgcgtggtgacaacggatttagtttatggaaatacaggacaacgaccgccatgatcgcccctaattgaatcacaacgttgaacatatccgtaaactgcgtggactgttgcatcttgataaattcgtcaactaggactaaatgccccgttgaactaattggtaagaattcagtaatcccttcaacaatccccaagattaccgctttaaaaatatctaacacaatggattcctttcttgttggcaatgattatcgcttgataatcccaatacataaagatttacgaccatccccgatgaccggtatatcaacattatagcaagcagctactcaagatagtagcgtccatgtgtatttttttggtaaagattaatttgtcagcgctaccaacgccgtactaaatgcattttgtgtttggtcatcaaaacaaacaatcgtgattgtctgaaccgtgtgggccgttgtctgcgcggttgcttgtaacgtttttaacgctaacggtgccgcaattgatagcggaaagtgatagacgccggtactgatagacggaaaagcaaccgtttgacaatgattctcagcggccaaattcagactgttgcgataactgttcgctaacaattgtaattcattatgctggccaccttgccaaacgggacccggcgtaattttggcttcaccagttgcacaaccgtgtaatgggcgacaggcagccagcaatgctggcccagctgcccgatgaatggcaccatcgacgccgccaccaccaagcaaactcgtattggccgcattaacaattgcatcaacggtcattttggtaatatcaccgtgaatgactttaatctcaaccatcttaaactgcccccataatcagattaacactcgtttgggcctgttgttttagctgtgccccactaggatcctgttttgccaataactgaatgccactgcgaacctgcattaaacttgctgcagcctcagcgaccgtggtcggtaaggttttagcctgaggtgaaagtaaaccgacgagtcgggtctgtaaatcagcatagatcgtttgcagttgggccatcaaggacgcatcctgcgacccaatttcggccatcaggttcaccatcaaacatcctgctggccaccgttcactctgaaacggcagtcgcaaacaagccgcaattaaagcgggcaatggtgtttgccgcgcccgctcacgttgaatcaattgatcaagttgttcatctaacgttatttgatagcgttcaagtgaacggcgtaacgcaacccgcttactgtgatactggcgataaaactgcgttcgtgacaactggctaacggtgagcaagtcgtcaactgtcgtttgataataaccacgctgccaaaattgaatcatcattgctgtttcaaccactgatgcgtccttaacaaccatgctaaaccctcctgaacctaacgctactacattaatcagcaattaaatactgaattccgcgaataatcgaccataagtagctagccactgcgactaatccaaataccgctaaaagaaccacggccaaccagccactattaacgatactgtccatataaataccgctaacgcctaaaataacgagcagtgtaattcctaaaattgtcggcaacaaatgtaaccaaaaagcccgtcctgcaacccgatgtgcttctggattagtactcgtcagcaaccaaacaattaatggaaataaaactggtaagaataaaatgcttaaatagctcaacgcgttaatcacccgattttgtgtcattgttataacctcccccgatatttatttcgagtatagcgaaagtctggtacttcggcaaataataaacaaattgttaaaatacttaggactctcccaaggttacgcgccgaatgttaacttacgaccacggtctgctataataatgacataacctaaccttgcaatcgctagttgccactgtacaacccgggagcgaacggttcatgttaggatttaggtgcattagttaagatgcggaggaaaagaaaatgacgaaacgaatgagtttcaaatttaaatgggttgccctcgttgccaccctgatcgttgggcttggcagctggcaagtccttgcgcacgctgacagtagcagcgatgaaccaattgtcacattaggcagtagcctgactagcagtcaaaagactgggacgatcaacacgttaacggctagcttgaacggtgccgattatcagacgctaactgttaacggcgatactctagttaaatacctcaacccatcaggtgaaagtttcacaagtagctcaggtgtgtggtccagtgcgatgattcaaaaaacaagttctggttctggaattaatgtcaaaattttaaattataatggtagtaataacatcaccactattacggctaaccagtataaaaacgccgcactaacggctgggattaccgatgctaatatttacgtcacatcagctactccaatcgacggttcgggcgcactagccggtgtttacgcagcgtacgcaaaatctggtaacagcttaaacacgaagcaagtaaccgccgcccaagatgagttaagtactctcagtggcatcacccaagcaaataagagcaaggatggttatactgattcccagttgaacaacgctgtggctggtgccaaaaaggaaatggcccaaaaaggaagtaacatcactaaaaacgaaatcacgaccattgtcaatcaacaaattaccaataacaatttaacaaatgtcattactaataatcaaaagactgaaattattaatttgttagtcaagatccgtgattcaggtgcattagattcttcaagctttaagactcaagccaactcgttgatgaagaacattcaatcaaatgccaagggtgtcttcagcaaactcaatactaaagaaaatcaaaacttgctccaaaaaatgtggagcgcgattgttaacttcttcagctctattttcaaatcaatctttggctaattattaatctcggatactcaaaatcggacgacaaaactgcaatcagttttgtcgtccaattctttttaagccttgaagcataccattaaataacgatcactggcttggcaaactattcaattgccaagtgatagttccagaataatttttagccatcacacgaccacccttgacgtgcaacgcaacgttattaacattccaaatttgttgattagtcccgacgccttgttgactagtcgtcccagctattaacgtttgttgggtagcacctggggttaacttaatcacggctggtaaggttgcctgattttggtcagttgccgtaacccatttactagtactagcattcaaatattgcgctgttcctgatgttaacgtcacgtaactacccgtcatggtcgtcccatcagtagctgtcaacgctgataattgggccgtcaattgccaaccacttggggtgtcccgtgtatcagtcacttgtgtatacacactatcctgcccatttttctgaccaccaactgttgcatacttctgtccatcagtagcagtagccaattggtcttcagcggctgatggtgacaacaatgggtacgctgtatccattgttggaatgctgtgctgtccaaagttcaaatgtgtaggtacagcgtccaacgataatgggcccaaattgttcgtcccgccagtcccaggcttgctaggatcatcaggatcaattggattgacgattaaatccttagctactgtaaatatcggtgctggttggaaagtcgcatcatgatactgctgcccatttggataactattaggatcaggattacgatttcctagactatcagccatataaataataatcttgtcaccaatttttaacgataatccggttaagttcagtgaccaagtcccattggcattgacaaccgttttgacattagtttgaatctgcccattcaatactaatgtgacctgcgcacctggctctccattttgaccactcaccgttcctgttgaaactctaatggggtccggtgataccattgtggccggattaggcggcgtcacatcaaccaccgtcccggtagccgtgaccgtcgttccactggtattgctagtcgatgctgtgaccgtcgttccagcttttaaaaaggtcccgacattagctgttgcgtagccattactatcagtttgggcagtgattgtcttaccattaacgctataactcacggttaattgccctgcactagcatactgtggaatataattaaccgttccgtcatcttgaacaccattagtatcaggaaccatcgccacaatgactcgcgtccgcagcttctgatccgcatctgttagcttggttgtcccatcatacggattattaaatgctaattgtggcttctggttagtggcactaatccgacgcattttagaagataaataattactttgcaaattactatccgtggccgtcactgctgaaccctgttgtaataactgagatacgttactatacgaataatccgcaccgcccgtaaccgatgatgctaatttccacaagctaatattactatcttggatttcaaaagtgcccacattatcttggttaatcgaactagccgctgcagtcgttccagttgagctattacgtaaatccaagttgttcggattaataaatcgaacagtagccaaacgcgcgtaatttcccgaaataagcggtgctcccgtagcagcaattacataaatattggcaccactactactttgaatcgtcgaagttgcattatcagaaaaagagattggcgattgacttctagctagtgacgttagattaacggtgctaccagtatccgcgtaaaaattacgatgatattgtgacccataaaagtacttgttagagtatgcatttcctggaacgctagcattaaacgtggcatttttacccacattaatactttcatacgcatcaaaaataaccggataggtagtataggcggttgacgtagaactagcaggtcgtcgaatacaatttagcgtcgcgccttcttcaacattaacttgccgattaccagttccttgatagtcataaacaaaccagataaatgaattatcatcaccattggctattttcgatccagtgaatgtctgtccagcagctacatcaaggccaccacataagatgttttctcgaaccgttgttactcggcaattgccggtaatattgacttggttcccttgcgcactgacaaatcgccgacttgtattggtataactagtcccacttgggaccgtaatattactaacattaaatgtccaattcaaagccccaccggcaccatcgccaccggtggatgagccaatcaaacccgcatcatttccaaaagatccgattaatgatgcaaaattcataaaagtggccgtatacatcgtaccgctagttgcagtattatttcgggtatgaaaaccagcccgaccaatattcacgctatgaccatttccattcacaataatattaccggataatcgtgaatccaaagcgcctgaagcggcagtcggattactaatatcagccgtaatattaatttcatcaacactcgcatccttccaagcatcgactaattgagaccactgactaacatcaaccacattcgaactcagctgagctaaccgagtgactggtattaatggactagatttggcactcgccgttgcttgcttagttggtgctgatgagaacacttgactagcagtggatgacgatgagatgctggccgaactatcagttgtctcacccgcagattccgtgaccgctgacgattgattagcagcagtttcttgtgaaggctcgctactgctagcactcgtttggtttaccgcctgacttgaaagcgtcgttgcagctgaacgtgaactgtccaaacttgctgctgatgatgtcgcttgtcgacttgacgatgccgtcgaactatttgtatcggttgccgctgaagaactagctgaactcgtactggcctgatcagcctgcgtttgtggttgcttaatctcgacattcaacgccggccctttttgatcatcggctacagcaactaacgccagtttttctgctttaacagctgttaatctaattggtaccttcgtttgcggatattcatctgaccactgaaccgttatcctgcgcttatcaggattgtacgcaactgtcagatgcttagccgtaattgtaaaggcaccattatcccccgttgtgtactgactatcatcgaaaactcgttttatttgcttaaactcctctggcccatctaaattaacctcgttcggtaaatcaatcgtatttattttagaggccgtatcaccaacctgtagttcaacatcaaaatgttgattcgttaaaatattatcgctagccgttgattttgcaaaagttaactgtggtaacgtagctgcttgagcggtcatatcggcgcctaagcttaccgttgcaccagcggctatgacttgtaacaataccatcaatatgacaacaattgctcttagctttttgatagtatcaccccttagcgcttattttgacgccgtttaattacccagaatatgattaaagcaatgagcaataatactaacaacacgataccaatcaaccaaccccaagtagttggagacgtgacgttaacagcatccgtagcgccaactacaaaatcttgctttagcgaccagacatgcggcttagcgaacttttcatccgtagttcgatacttgacgtatagagtgtaagtcccaggtaaaatgatcccccgattagtacgccactttaatggtaagtcaaagttagaattaggagccatcgaactactttttagatcagccaccgcgagctttttggtctgcccagctttgctaacgtaggcagcgacagtccctttgcctagaattgaagcgtggtaattttgaatattaccgataactgtcttgatgccactccgcttttttaattgaacatcagccaagcgtaattttggcaatggatcacgatttgacgttagtttgatccccacattgtaggcatattcgctagttaacgtcgcccccttggttttaagatgttgatctgcaattttaacttgccaacttcctaaaataatccctttgttcaatttcgttggcgtttttaactgtgcccgcacgatccgtgatttattagctgggatcgtcgtttcctcatccggtacggtaataatatcagctagttttacttttaaactagtatcatcattcagattagcagcaccataatcaatagcacctttcgcattagtatacgattgtaggaattgatttttgactttaatttcatgatttgcgcgattattaacacgcatcgctaacgaatatgttctcttcggttgaattttaaaatcccaataataagcgtcctttgataattgttgcttttcattaagcattggctgaacatcaaaagttaccgcattattggccgtgtcagcagcatggccaatcacagtcataccagccaacaaagtcattattagggttaacatccctaataatagcttcttattccagccgttcataaaagggcctcccttcaaaaaaacgagttaactattcaacatagccactcgttttcgttcattaagccgttggtgtcgagttcaatgtccaaacaatattccctgaataattcttagcggctgcgtgaccacctttaacatgtaattgcacattattaatattccagtattgttggttgacccccataccttgaccgtcaccaactttagaccctgccgtggctgttgcaacatcggttgtcgatgaagcgccggcattgagcacaattggtgttgcaacggttgcctggttcgcatccgccgcagtgacccaagattgttgattagcttcccctgtcagatattgtggtgtcccaccacttaaaacaactgacgcgttcgttaacacttggccgtcagaagccgtaatatcagaaagctgtgcctttaattgccagccagcaccagtcccccgtgagtcagaaacttgcgtgtaaatgatatcattaccatttttcttaccactagtcgtcacattttgggtcttatcatcattagctgtcgcaaggctctcctgactagcatcttttgaaagtaaagtgtaggccgtatcaacattaggttgcgtatgcgtcccaaaattaagatacgttggtaccgcatctaacgaaagtggcccgttgttcccagtaccaccgccgccaggattatccggattgtctggatcaacaggattagtcgaaccaccgttagacgtaaacgaaacatctgcttgagactttccagttgaaggcaaggtgtcagcggaagctcctaaattattgaatgataaacaagcaatactggctactgaaaccaacatagctgctttgagcgtacgtgactttgtcataagtcaattccccctaaaatttaattagcatattaatcttcttcatcaatagcgcgtaatacctttttgtacaaacatattaatatttaaatcaatattataaattcatctttattaacaaacttttagcaaactaattgacgaagaatatttatatgtctatactggataacttaaatcagtcattatccttgaaccaattaaagcataccaattaaagttaatcaagtacactattatgtacgtttactatttgtataaaattcactatttttgtaacttatgggggaggaactgtccattgaattttccagagctcaaactttctcaaacagaacgcgatttcaattttgattttgctatattggaacatgatttaagttattttttcgaaaagcgttgtcttgactacgccttggaacatatcaatagatttaatcacaaaatcaaggataacttatacaacgtccgcccactcattctaaaagaagccttaatttcactaacctgtgatctagcaagtgtcagcttttatcattatttgaacatgatcacattcgttaacttaagaaaggacattttgcattacctcacaacaacaacactaacgaatgatgattttatgccacttttagagtcaatcgttaacaattattttagcaatcttgatacacttgatattccaattgatggtacccgcctctctaagcaagtcgcgctagttgtctattatattgataatcattgtgatgagccattaagagcaaataccatcttagaagaactgacgttagatcctgaatacactaagcgtaaatttcgtaaagaactagggtttaccatcaacttctacattcgccacgctaaattacagcgagcaaagcaattattaattaatacccatcttcctataggtgaaattgcagaaagaatcaacttctacaatagcgccgaatttgcacgccagtttcaaaaagaattcgatattactccgagtaaatatcgcgagttgaatcaaattttttataaagaagaataaataggatatttactttgtacaataaaatatttttttgtgttttaaaattcgcatataagtttaatcactcttaaacttgatattaattctgcaatatcaagcaagctcctaaccaaaccttgaacgcgctattaggttaaaaggcaaccaaagttcatatgagtaagacgagtatttgtccgctcgtcttatttatacaaatcacccaatcaatgtgactactatacaaacagtaagcgctcactttttccaaaaataattactaataagtcttattttaagtacaagcacggattatatctgatagcgcaaacaaccagcttgacacctattaccatcgagacttcatagcacctatcgtcttgatcatttccgaatcacgatcagtggtcattaatgattataaaaacaaccctgttagcaccaaaagacgccaacagggttgtttttgtaattatctttaattgtaactgacactcaattaagcttcagcccgcttcaaatcagtatcagcatacgttgtctttttagtttgcttgctagcatcttcattaacaaacttgtccataaactcttcaaccaagttcaaagtctgatattgtttagctaaactgaagctttgacgccattcccggttgcgttgaatcaattcagtaaagacttcatgttcaatccgagcgccttctggtgttaactttaaaactttgttacgacggtcatggtcttcagcttcttgatataagtaatctttccgtaataagcgaccaattaagcgtgagattgctgaacgcgtcacaccgtgactttcggcaatatccatcagacggatcttaccttttgcttcagcaatatcatataaaatgtaaaattcatccaaagtaatcccatgttccgttgcaggttcagcaaacatatctgataagtttttaaagccatgtaaatacatatggctaaagcgattaaaaaattccatatcttcattcattattcaagtctccctttcactagtcgaattatcattaaattcccaatcataattcgccccatacttttttcataaattagtaagcgtcgtttatcatttccccgctttaaagtgtactagtatattttacgaaatacaagtaatttagattactttaatattaaatttttatttcagtactcaagtcaagggtcgcgtgtttatgcagatacgtgatgaattgctgataataatagtcagtattatacttggctgtgctcaaataaatttgatcaattttctcagtattctcacctaataacaagtaaaacgcttggtcgatattttctgcaatcatgccaacactagctcttagaattttacgcttgaaaaaaacagccataccaccagataacgcgaagttcaacgcgtatctaatcatagcagcttcaccttctacgccgatagcttctagccagtctagtgtcactagcaccatctcagtcgtcagttccggactctcgaagatgtcctgaataaagtgttccatggtcggattttcatctaacatccgcaaaacaaagctcatttgaatcattgttcgctgatacgaagacagcatggtcagctgttcattactatagataaaagcactaagcgtcaactcatttaacatcgtacttaataaaacgattttcttcgggaaatagtgttgtagcaacgacttactgatatcacaggcaatggcaatgtccttcatctgaacgttcgcatacccctgctcggcaaacaagcgaaacgctgtattaacaatctccattcgccgttgcgtgttccttcttcgtggcaagaaaggtgcctccctatcactgattttcaatcattctcttttaataaactatactaatatagctttgaacgcaagtgataatttaattggaaagttaattaataacagcctcaactatcaaaatgatcattacttatcaataaaatccgcgagtacttccaactacaagttagttaacaaccactgcggcttaaagtcttaatcgtctaaacgcactagcagctattcatcagccagaaaagaaaacgctttcttatgtgaaagtttgtgctaaaattaacttatcaacttgcagggaggctacaatatgagcactaaaaattcttatcaattagccgatatcggtcgccataatccgatcttttcacagatccgttctaccgtcgaaacggccttttacggtaataatatgcaccacgttgatgatatcgctgccgcttaccaccgcgctactaaggaccccggaaccgttattacggacctcccaatctatcgcgcaacggatttaggcttaccagctgatgcaaaaatgttgattgccaatacgggtaaggttgttggccgaaccgcacaagcgcgccggattctaggcaacccgggcgttagcgaagccgatatggccggtcgcctacgccaagcactatttgctagtgctcacaaggacttcatcacgacggacgttctggtcggtttagacgaagacttcatcgtgcgggcccacctcgcgattccggacggttttgccaataatctactttcttacatgcttaacttccagcccatcaccgctgcttatcaagaaatgttcgatcggtccgttgcttatccagaaggcgatatttacatttacgctgaccctacttaccatgatccagattatccagacggcctggctatttttgatccgcaacataatacggctgccattctaggaatgccatactttggtgagttgaagaaatcgactttgaccttagcttggtcgatcgcccatcgtcacggcttcgttgcttgtcacggtggcttgaaggccttccacttcaaggacaagcaagaccaagtcttcgccatgttcgggttatcaggttccggtaagtcaacactaacccacgctaaacacggctataaatacgatatcaccgttctccacgacgacgcctttgtcatcaatcgcaaggatggtagttccgtggccctcgagccttcttactttgacaaaaccaacgactatccgatgacgtccgatgagaccaagtattttatgacgatccaaaacgtcggcgtcaccttagacgatcagggtcgcaaggtccttgtcactgaagatctgcgcaacggtaacggccgaacgatcaagtcacggtacgcttcgactaaccgggttgataaggaagccgctcccatcaatgcaatcttctggattatgaaagatgatagcttaccacccgtgattaaagtagatgatcccgtattagcagcgacattcggcgccactttagcgaccaaacggagctcggccgaaaatattattggtaatgtcgaccgtaacgccctagtgatcgaaccatttgcaaacccatttagggtctatccactatcagaagattaccatgatttcaaggcactcttcgaagaacgccatttagattgttatctattgaatactggcttctttggcgataagaagattcctaaggaagttaccttgggtgcgctggaagccattgtcaatgatacgaccgagtgggagtcattcgcaggcttggagcacatgcaaaacctaaagttagctgatttcccagttgattatgccaatgcagactaccgtaacttggtcgccactcgtttaggaattcgggctaacttcattgatcaatatcaacacaacaatcatgaccagcttccccatgagattattgatattctggtccacctacaagatcaattaaaacaaccaattacaaaataggatggcattcgttccccgcttcagaccaattaaggttataataaaagtagcaggtatatggcactgaacttttacgaattctaaaaatcggggtgaggagcatggaactaccattaagtcaattatcagaaaagctcatcagttttgaacgcgagcaccatcttacagataacgaccttgcgtttggcagtcaattatcagttgaacggattcacaacattaaatctggtgaagcaacgccaactcaggaagaattgcaactgttgaagaaattcatgaatagcaaagccaaagcttaactgctagttcagcgataaagcctaattggggcaaagatcctcactaaaaactggtcgtccattcgaccagtttttttgttacctaccatccagattgcgttttaatttaccctgttatcacctcgtgctatactcggcacaacttataaagataagggtgaccaacatggcaatgttatacggtaaacacaatcatgaagctgaagaatacttggaaccagtctttggtgcgccttctgaacaacatgatcttcctaagtatcggttaccaaagcattcattatcccctcgagaagccgatcgcttagttcgtgatgaattattagatgaaggcaattcacgactgaacctggcaactttttgtcagacctatatggaacccgaagccgttgaattgatgaaggatacgctggctaagaatgccatcgacaaatctgagtacccccgcacggccgagattgaaaatcggtgtgtgaacattattgccaatctgtggcacgcacctgatgacgaacactttacgggtacctctacgattggctcctctgaagcttgtatgttaggcggtttagcaatgaaattcgcctggcgtaaacgcgctcaagcggcaggtttagatctgaatgcccatcgacctaacctcgttatttcggctggctatcaagtttgctgggaaaagttttgtatctactgggacgttgacatgcacgtggtcccaatggatgagcaacacatggcccttgacgttaaccacgtcttagactacgtggacgaatacacaattggtatcgtcggtatcatgggcatcacttataccggtcaatatgacgacctagccgcactcgataaggtcgttactcactacaatcatcagcatcccaaattaccagtctacattcacgtcgacgcagcgtcaggtggcttctataccccatttattgagccgcaactcatctgggacttccggttggctaacgtcgtttcgatcaacgcctccgggcacaagtacggtttagtttatcccggggtcggctgggtcgtttggcgtgatcgtcagtttttaccgccagaattagtcttcaaagttagttatttaggtggggagttgccgacaatggcgatcaacttctcacatagtgcagcccagctcattggacaatactataatttcattcgctttggtatggacggttaccgcgagattcaaacaaagactcacgatgttgcccgctacctggcagccgctctggataaagttggtgagtttaagatgatcaataacggacaccaactccccctgatttgttaccaactagccccgcgcgaagatcgtgaatggaccctttatgatttatcggatcgcctattaatgaacggttggcaagtaccaacgtatcctttacctgctaatctggaacaacaagtcatccaacgaatcgtcgttcgggctgactttggcatgaatatggcccacgatttcatggatgacctgaccaaggctgtccatgacttaaaccacgcccacattgtctatcatcatgacgcggcacctaagaaatacggattcacacactgaatcatcacgttattttgataaaatagttaaacttcagaaaacaattattatcactcgtgtatacaaaaaatagcaccatccagattctgacgaaccgggatgatgctatttatccatttaagggatattaattacatgtggatagcaaagcttggtgtgtagtaagctgtgctcttaattgaaacagtttcaccataagttggtgaagcgatgtattggccaccgcctaagtaaatcccaacgtggtaaggtgctgaatcagaaccccagaaaatcaagtcgccagcttgggcttggctgaatgatacgtgagtaccaatcgtagcttgagcatatgtggtccgaccgattgaacgaccaaccttagcaaaggcagcttgcgtgaatgcagaacaatccatttgttcgtaaggtgtgccaatgaaggtcttagcagcagcaattactgaactgtatgatgcagttgaactagtcgttgatgtactagttgatgctgaagcactgtaggccgttgcagtagcagtcgttgttgatgaactagtcgtgttacttgcagttgagctagcttgtgagctcgttgaagtagcagctgattgcgtactagttgcagtcgtgctagtagacgatgctactgaagttgagctttgtgatgcttgtgaagctgaactttggctagctgagctttgtgaagttgctgaactagttacagcacttgagctagcttgtgaagctactgaactcgttgaagcacttgaagtgacactgcttgcactagcagttgaagtgctacttgattgagcagctactgagctacttgatactgcttggctcgtactacttgcactagtagttgatgagctggtagcagcagcgctagtagcttgtgaactagttgaagttgcggcactagttgacttagcactgcttgcactagcagtggtcgtcttagtcgtaaccttttcaccagttttaacgccaggaatattgatggttttaccagcaataattaagttagggttgcttaagccattagcttcagcaatcttgtcaacagaaacatggtacttttgtgcgtacgcccaaacagtatcccctgctttgattgtcattgaatcggcattggcaactgcttgactagtaactaacataccagctaaagcagcagttcctaacatcacttgtttaatatttactttcactttaataatgatcactccaaaaagaatgtcacgtatgtacttcaagccaacgtctatactactcaatttgtgttacataccaataccagcaaaataacaatatgttacgaaagttacaaaaccgtaacaataattagccatcgtaacattttcgcgctgaaaccctatcataccggcatcgttttattactaaaatttgaaactatttagcaactttgacgaaaaaaagttatttttattttaaaaagccgaatttccagtgacaattcctggaaattcggttaaatttcaatttaattacgaccaaacgttcggctaatttggactatttagatattcgttggcgatgatgcgttcgcggtaatcctaatagccatcgaatatcattacccgtaaagttcaacttcaagaattcgccactttgtccctgttgatacatggtcggtaatacctggtcttgcaacttgatcacttgctgtgcgatctcttcgtcaaataaatattgccgtgtcgcggcagcaatttcaccgaccgtaaaaatctgagcagcattagcaaatatctgctctttgcccagcgccaactgggcttgtttaaactgggcgtaggactgatccaagacttggcctgcttgagtttccaatgcggttactgtggtcatgatgcgcacctcctaaatttatccctattgtaaccgccaccgctgactttgaccacgctaaaccatgctttttaaataaaatttgctatactaaaatgacaaaggggaaattaacttgacgaatacagacaatcgttattatcaaccaaccgacatcaaagatgcacttcaaacaattcaaaaattatttaatacttataccgatgccccattaacacccgaattaatgacttaccatcaaaaattagttaatcagttagctactaatttattaccactagcacaacaacaacatgacaaattacggattacccaaattaattcaatgatggccgtcatgcaagattggctaaaattaaggctgaacggtcaagtcttcggcggcaaaatgcaacacttcaagtttgtcagcaaccaaaaagcacagtacaaacgacgagtgcataaaattcgtggcaatcaaaatcatcgtgctagtcgccattgatgaccaaactagacttgcacgactagcattttgcggtatactaaaagtgtattgggcccttagctcagttgggagagcgcctgcttcgcatgcaggaggtcgtcggttcaaatccggtagggtccattttaatagacatcaaaaacaattttatggaaattgcgcaagcggaagcagcggttcatcacatgccactagctgaagttcatttccatgaagtgggtgcgttggattcgattgttgatattgtgggttgctgtattgggttggaattgatgcagattgataccatcatggcttcaccgttaagtgatggcagtggctttattaacgttgcccatggtcagatgccagttcccgtaccagccgtgatgcagatgcgagttggtagtgccattccgattcaacaacggttggatgtgcatactgaattgattactcccactgggatgggcttggttaagacgctcgtacgtgaattcgggccgttaccggaaaatgccgtgccaactaaagttggttatgggtttggtaaacgggacacgggtggtttcaatgcactgcgagccgtattattcgaaaaaaaaaactaagtcagcaaatcgttaaccggacggctgatgctatcttaatgattgaggctaatctggatgatcagacgggtgaaggactggggtacgtgatgaaccagttattaacggcgggcgcatacgatgtgttcttcacgcccattcagatgaagaaagatcggccggcgacaaagttaacggttttgggaaacgttaacgataaggacttactgactaagttgattttacaagaaacgacgacgattggtgtgcgataccagacgtggcaacgtactattatgcaacggcacttcctgacggtcgcaacgccgtacggtgacgttcaagttaaagtggcgacatatcaggatattgagaagaagatgccggaatatgcggattgtgcccagctggcgcagcaatttcatattccgtttagaacggtctaccaggcagccttagtggcggtagatcaattagatgaggaggcgtaattttttggtacatcagttgattgctgaatttatgggcacagccctaatgattatttttggggtgggtgttcattgtagttccgtattaaagggaaccaagtatcggggttccggtcatatttttgccattacaacttggggctttgggattagcgttgccttattcatttttggcaatgtttgcattaacccggcaatggttttggcgcagtgtctattaggaaatatcgcatggtctttatttattccgtattccgttgcggaagtgcttggtggggtcgtgggctcagtgatcgtttggatcatgtatgctgatcattttaaagcctcaacagatgagatttcacccattacaattcggaacttattctgtactgcaccagccgttcgtaacttaccgcggaatttctttgtggaattatttgatacatttatttttatttcgggtattttagcgatttctgagattaaaacgccgggaatcgtgccaattggcgttggcctacttgtatgggccattgggatgggacttggtggtccaactgggttcgcaatgaacttagctcgagatatggggccccggattgcccacgccattttaccaattgccaataaagccgatagtgattggcaatacggtatcattgtgccaggaattgcgccctttgtcggggcagcaattgccgcttggtttatgcatggcttttttggaattaattaaattaaatagaagaagggttttattatggcaacattagcaacaaaaaaagcaacgttagtagcagcattaaaggatttacaacgggtcaccgtggccttttctggtgggatcgacagtaccttagttttgaagatggccctcgatgttttaggccgtgacaatgtgaccgctgtggttgcgaactctgaattatttacggatgaagaattcgataaagcgatgagtttagccgaagaactaggtgctaacgttcaaggaactacgctagactacttgagcgatgaccacatcaagaacaacacgcctgatagctggtactatgcgaagaagatgttctacagccggttgaatgacattgcggctaataacggtagtgccgctgtcttagacggtatgatcaagaatgatgaaaatgattatcgtcctggtttgaaggcccgtagtgaagcgggggcccggagcttgttacaagaagctgatttcttcaagactgacgttcgggccttggcacaagaactcggtttgacgaactggaataaagtggcgtcatgctctgtatcttcacggttcccatacgggacgacgttgacacatgacaatattgctcaagtaatggccgccgaaaaatatttgcgtagtttaggttttccaacggtccgggttcgtttccacaatgatattgcgcggatcgaattaccagaagcacgaattggtgatttcttagtctttaacgaccgcgttaaccgtcaattacaatcacttggattccgctacgttacccttgatttaggtggcttccgtagtggtcggatgaatgatacgttgaccaaggcacaattggccactttcgcctaggcctaatcaaattaatgatagtggtgtcgggattaatcggagatgggcggctgaacggcggtgatcatggttcattcgcccacccgatgataatcgtaaccccagccgatacgcacatgttgcgattatcgcctgacaccccaaaaagcgcagttcaaggccgcccttgagctgcgtttttcgtatcttcatttttagatcaacaggcgtcaaaagtcacgacgagtttaccaacgacttgaccagcttggagttgttgtaaaccagttacaagttggttacggtgcaagacctgagtaattagtgggtcgaccttgccagtttggaccaaagctaataaggcggcggtcatttgcccaagatcggcaacttgcgctgggttaccgctacggtgggcaccaccgaggtccaatttactgatagttacaacttgattacttggaaagtggtccggagttgctaatgcacagacaagctggccattgtaagctaagcgcggtaagtccgcatcagcatgaccaatggtattaatgatcagatcaacaccgtgctgctgcgttaggtcttgaatgcgtgtggtcacatcttcatgatggtaatcgatttggacatcgggatgcagcggtgccacgaaggcttgcttggcctgtgaaacggtcgtgaagacggtcttgccagcagccttagcgagttgaatagccatactgcctacaccgcccgcacctgcatggatcagcacagtttgcgcggcatttaaattggctttgcgcaggagggcctgataagccgtcaatccagcgcagagactagcggcggctgcttcaaagctcacagtcgttggaatcttagctagcacggctgctggtaaactcacgtattcggcaaatgtcccattattggcgagattagcgtgcccacaaactcgttcgccaggccgaaaattagtgacctcagcgccaaccgcctccacgattccagctgtgtctagtcctagtgtgtgtggatattgccaggcggcgttacccgccgcaactaatttaaaatctaccggattgagcccgactgcttgggtcttgatcaacacctcagttggcccgaggttgggcatgggccgttcttgccattgaagctgttccatagtttgagcgggtggatctggcacaacaagtgcttgcatcttcaatcactcttttcttaaaggcatatttgctttttattataaccggtcgcggcggtgaatttaaactttaatgcctaattaattaagtagcaatgagggtgattcggctaacggaaagattgacgttagcggttacaatcgttagactaaggttagtaattgaatatttttaaacactaggggtgtccaaaaatgggctgagatggtgctgtaagtgccgatccctctgaacctgtaagctcaaacttgcgtaggaaagtgtcacagctaatgttagcggccactggatcaatgcatgttgattggtggtcgtttttgattggtgtgacggtcaatgaggaggagaattgctatggaattacaattattgaatactttacgggatcacaatccgattgtttttaacattgccaattttgttacggttcaagacgttgccaatgggctaaacgcgttaggggcctcgccaattatgtcagctgaagtccaagaagcagagacgatggtccaaattgccggggcagtttgcattaatttaggaaccttgaccaccacccagattgatcaaatgcgagtggttggtaagcttgctaatcagtatcataagccagtcattcttgatccggtggccgtcggggcggtcccttatcgaaaagaagtcgcgctagcattactatctgattttcaagtcgatgttattcggggcaatgctggtgaaattgcggcattggctggcatggattggcaagcgaagggcattgatgcggggagcggtcagggcgacctggttgaaattgctcaagcttgtgcacagcaatttcaatgctgtgtcatattgtcgggacctactgatgttattacggatggtcggcgcgtggttaaagtcgctaatggtaccccgcttttccaacgtcacgtgggctcgggcgatttactttctagtatcgtcgcggcttttacagccgttagtccaaccgatatttaccaggcggcgcaagtggcttgcttagtcttagcgggagcgggggaacttgtcgccagtcagctgacggccgatcgtcccgccacatttgccattgatttgattgaccggctgagcttagtgacagtgtcagaaattcaaacaattgctaaagttgattaaatataatgaagggtcgcgagatttaatgaatgaatttccacaagtggcaacgattgctggtacggatagtggtggcggtgccggtgtcatggccgatttaaaaacgatgcaggcacgtcacgtttttggtaccgcggtagtcgttgccgtgacagctcaaaatacattgggggtccaagattttatggcaatgccgacgaagctcattgacgaacaatttgcttcgttagcagctgacttagacattcgcgcttgtaaaacggggatgcttgcggatgctgaacatgtccatgccgtcgttgagaacttgaaacgagttgattttgggccgctgacagttgatccagtcatgattgcgaaaggcggggcggcgttattagccgcggatgcgattaaaacggttcgcgacgaactgctcccgttagcgactgttgtgacgccgaatttgccggaagcagaacgattaaccggtcaggcaatcactagtaatcaagcgatggttacagctgggcatgcgctacaggggttaggtgctgacaatgtcattattaaaggtgggcatggtgataatcctgatttagctaatgacttcgtattgttagctgacgggaccgccttttggctttcggctccacggattgatacggtgcggacccacggcacgggagataccctgtcggcatgtattaccgccgaattagcaaaaggacggtcaatggctgcggccattaaaacggctaaggcgtacgttgctgggacgattcaggatggtatccaggtcgggcatggtcatggcccgttgaatcattgggcaaccccaagtgagcaggtgatcgttcatgacgcttaaatttgaacccacacaattacgtgcttattttgtgtgcgggacacaagacgtgccgggacaggatctaaatatggtcgtccaaacggccttggatgcaggcgtcacggcattccaataccgagataaaggcaatagccagttgactacggctgagcgttttgcattggggcagcagctgcgggaacgctgtgcgcaagcgcacgttccctttatcgtcgatgatgatgtcgagctggcactcgcactgcaagcagatgggatccacgttggtcaaaaggacgaccgggtgacacaagttattcaacgggtcgctaatcaaatgtttgtcggtttgtcttgttcaaccttagctgaagtgcagattgctaaccaattggaaggcattgcctatcttggtagtggtcccatctttccaacgacatctaaggccgatgcggatccagtagtcggtctgacggggttgcgacaattagtcatgactgcatcctgtcccgttgtcgccattggcggaattactgtcgcgcaattgccagctattgcggctactggtgcggctggcgctgcggtgatctcaatgttaacgcgtagtcccgatatggccgccacggtcaaggcgatgctaacggctacggaggggcactgatgaaacatgacgggatttttcggagccaatttttattgtggctcggtgcggctatctcaattgccgaaatcttaacaggtacgctgatggcaccactggggctgacacgcggattggctgcgattgtattggggcacttgatcggctgtggcctgttcttggttccagccggctatttgggggctaaattacaccagtccgcgttagcgtcagcccaactggcttttggtcgcggcggggtgttactagcgtcaggactcaacgctttgcaactcgttggctggacggcggtgatgatcgtcaatgctcagttagccatgaacagtattagtggaaagctatttggctttcgaagtccgctattaatggcaaccatcgtggcgattttgattattgcgtggttgctcatgggtagtcagttactgttcaaaatcaacaatgccgttgtgggcttgttggtgctcgggacggtgttaatgctcgtaatggtatttatggcaccgacaactagtcagtcggtatcaacgactagcatgacgtttgggcaagcagtggaattgaacgttacgatggcactctcatggttgccactaattggtgattatacccagcgtgttgatcgtcctttaccagtcgcactagtcagcgcgggtggctatatgttaggcagcttagtgatgtttgtgacggggctattagttgtgttacggacagggcaaactgatatcacggcattgctgacgcggtccggtttaggattggttgcattgctgattattgttttctcaacggtgacgacgacatttttagatacttattcggccgccacgagtttggctaatctgaccggtagccgccatgttaatcgattagccgttggtgtgacggtagttgggctattgattgcgctgacggttgccatgacgtattatcagaacttcctgtatttgattggttcggtcttcacaccgctatatgcgattatcttcgtcacgtactttgtgcggcacgctacgttaccatactggttgaacttttgctggtgggttgtggggattgtcgcctattatcagttacaaaccattgatttcattggtggcacgacgctattagtattggttgggctgagcatcgtcgtctggttgacgggaattatcgtcaaaccaaccgagctcgaatatcgcgagcttagtcattgacaattagatgtaaaaagtaaatgataatcccattggtaatacgcatgttaccgtgggatttttttgagagagggcgacagaatggttaaaccgataattggaatcgcaccaggcgttgtgacagtgaacagccagatgttcccagggcgggtccgtgattatgtgaatcgtgattatttgaaatcagtaacggataatggtggtgtgccattggtattaccggtaacgaccgacgcaacgacgattgaacggtacgttggaatgatcgatggtctactactttgtggtggtgcagatgtggccccattgacgtatggggaggaaccccagcctaaattgggtgggatagatccggaacgggatcagtatgaaattgcgctgattcgtgccacccacgctgttggtaaaccggtgctcggtatctgtcggggcttacaaatcttaaacgtgtgctatggtggcaatctttatcaggatatgagtgaactgccagctggtcagggtaccttaaagcacatgcaaggacaattggccgcttacggcatgcatcacgtgaaggtcgtaccaggtacgaccttggctgaatatttaggcaccattagtgacgcaatcacggtcaattcatttcatcatcaggccgtgaaacaagtggcaacgggctttcaggtggtggcccaaagtgcggatcaggttgttgaagcaattgaggcgacagctggtggtctacagttgggtgtccagtggcatccagaaatgatgcaacaagtaaactccgtgcaggcgcggttgtttgcggcgtttatgcgggcttgtgtggcgtagatagcattgactagcaaattgataaaattgggcgtggttattctgaattgtaggataaccacgtttttaatgtgcagctgcaaaactaatgaatgtttcacgtgaaacatctgaaatggtgttggcaactagataactaatccaagatattgtaagctgacgtgtaaaacaattcgtaaagctgttaatactggcaacgctttcgtataatggaataaagttattgttaagggggtgaccgctatggaacgaattgaagctggcatgagcgtaatgacgttgaagaagcagacctatcgggttatcgctgtgattaatcaggggcaagaactgttagttcgcgcccacgaaccagaaacagctgacattgaaataattccagtgaccacagttgttcaagtaactgaacaaaattcgacaggcgatgcagccgtcgcattggatacagtcacggtcgttggcgaacggtatgtcgatgatattgtggcaacgttaacgacgctcagagtgggtatggcggtgttgctccagcgagaaagtggcaatcaatacgatgataatgccatctcagtgtggacgttgcaacatgctaagttaggctacattgcccggtatcagaaccagccgtacgcgacactgatggatcaggggcaacgattgtatggcatcgtgacggtattggatcagcaaaaacagcatcttgaattgatgctatggcggactactgcagtcccaagcccgattgaggcgttgcaaatccgccaacgattggctaagccgaggacaaatttaggggcggtgccaacgcattcgttacagacaccgttaggaacaattgtcatgatgtgcaatggtcacccgattaagtatcagcaggttccgttatcgccatggttgacgcccgctgatgaattacacgtcaccaaacgttatctattaacgcctgattggtcacaagtgccgccggacagcctcattacttgtcaagtgacggcgaaggccgacgtggttcagcggtggcaaaatgaacacatttcagcagcggtcttaacgaacgctagtagcttttatgtggttggtatcagtgctcaaaccaagacggggctgaatgataacttggtcgatgatgctgcgcaacccgcggttatttaccgagttggccaggttagtgcacatatgcaggccggcttcatggtcagctgggcgccgtttggtgatccgcgcgtacaaccagcactgaaattagcattgcacttctcctcacaaccgctagttccttaccatccagtaacacctagtcgcaccaacgcgacgtttacgcagcaagagttggcagccttgttagtctccgcattaccaaattatcagggtggtcaacgcttagaaccaagtgtgacagcgataacggtagaaaaattgcggcagacgttaggtgatcagacgtatcatgcgctggcgaattatcagcgtcatgttcagctagttgcgggtagtacggaaggtgtcaacgagaccttgttacaggcgttgattcatgcagtcacgtatcatgagttgacgaccatgcactactaccagccgactgtagggatggtcgaccaggttatttatccgattcaattatttagcaccacgactaaggatgaggatgatgcgcaattagtgggttgcttagcgctttacaattacgaaacgtttgaaatccaacaggtgccgctgacggcaattgctcgtatcgcgattattgccgatccggagcatccccagacaacaccggagacggaaagtccggattggttacgcatatttttacatgggtggaatgacgatttttgaacgaacagtcaaaaattaatttgcttacgacttataagtattcgtgatacaagccagattgaattcgataaaaaatcccgctgaggctttaaactcagtggggtttttggttaggttatttggttgccgaatgggtctgtaaatattcctgggcggcgtgaatcatatctgcattttgttgatttaacaatggcggcaagttgtcgaagtcaaagtagtcgagtttgagtgtttcatcagtggcttgggtcagaacgtggccgccaatgggttttacaagaaagagtgcactgattgtttgagctacatcgccgttaggataggccgtctcgcctttatcaaagataccgatgcgatcaacaacttcgacatcaatgccactatcttctttatattcccgcacgcaggccgtggcatacgtctcaccgtattctagatagccaccgggtaaactccagttatgcgtatcggtacgaaggttcagcaagacttgttgctgatcgttgactaaaataccagcggccgtattcaaaatgattggtttgtgaccaaccaaagcccgaatttctttaatgtaatttgccatgatgaaacctcgtttctagtttaattacccttattataccgataattctgactgaaagctgtttgttgataaatttatacgaagcatgctcgaaccgcgttagagcaagtacatactgactatgtgttactaaatccgtttgcgtcggtgcacttttttagctaagataaaagctatatactgtcagccgtgatagtgtgagttctttgattttatgaaaagagagtaatttatgcagagaaaattaagtacgggccagatgcaaatgattgcactgggcggcacgatcggagtgggcctatttatgggatccagctcaacgatcaagtggaccgggccgtcagtgctaattgcgtacatcgtatcaggggcctttctatacctgattatgcgggcactaggtgagatgctgtatgtcgatccgaataccggttcgtttgccaagtttgcttctgaatatattcaccccgtttttggatacttgacggcttggagcaacatttttcagttcgtcgttgttgggatgagtgaaatgattgcactaggcggctactgccggtattggtggccgaacttgccagattggattccgggcctaattgccattgtattcttatgtgcggccaaccttatctcggttaaaatgtttgggacgctggaaacctggttctcacttattaaagtggtgacgattattctgatgattattgccggtttaggtctgattatttttggtattggtaacggcggtcatccaattggaatcagtaacctgtggacccatggtggtttcttcactggtggggtgaagggctttgtcttcgcactagcaattgtgttggcgtcgtatcaagggattgaattgattggagtcacagctggtgaagctgaaaatccacaaagcacgatcgttaaagcgattcgttcaacggttgcccggattttaatcttttacgtaggcgccatcttcgtaattgtcagcatttacccctgggataagttaagccagatcggttcaccgtttgtacagacatttgccaaaattgggattaccgctgcggcttcgattatcaacttcgtggttattacggcttccttatcgggaacaaattctggaatttatagtgcgagccgaatgacttacacgttagcggaaagtcaccagttaccaaggaagatgactttattaaatcgtcatggagtaccattttattccgttattgcgattgcgaccggaattctaattggagtcgtcttgaatgttgtgttaccaatgtttttcaaggacgctagcgagattttcgtgatggtttacagttcgagtgtcttgcccggtatggtaccgtggtttgttattctagtgagtcaaattgcgttccgtaagcaaaacgcagccaagatggcgaaccatccttttaaaatgccattatcaccctattcaaattatttaacgttggccttcctcgcgttaacactggtcttcatgtttattaatccggaaacgcgctactcaattttagtcggtgttgtatttctagtcatcatgacattgatttatttccgtaaatacgccggtaacaaggaagaaacgttgtaatcaagagtacttgccagtaaatggtaagtgcttttattttgggcttttattgcgttaaaattaggtatcaatatcaatataattatcaggaaaagtggtggcacgatggtcaagcaaggacattatgcaaaagtcagtaaacagaaacggttacgacaattaaagcaacgacgtcaggcccaggagaagcgggcgattatgccagaaatggttagcgaatttttgcaagtgcgttaccacctgacgcaagcggcaaaacagcagccggcgatgcgacagatgatgcaacgttttatggcacagtggttagccgcagggcaagcagaattgagcgacaatggtcagacaacgtggtcagtagtggcattgacgaagcaaacgttacagacctttaatcggcagttaccgtggcaggggtatgccttagttgaccaggaaatggcgcgctggacggcttttctgaacaaggaagtgccagctgtgccgttaagtgagcggattacgttaactgaggcactgtccccagcgacgtggcaggcctgcctatcagagcaattagcaatcaatgccctattagcattaactggtgattcacgacaattgggccaaataacgactgagcaagtacgacagctacaaaacagtattcaaacagcaacggggattgattgggaaaaggttgctcagttgcttgattcgacagtaattgcccagaatacactttccgaagctgggttggatgacaaaacgcgccaatggctagaaaaattacagaagctaacgccacaagattttaacagccatgttgaatgaacagtcaaaaaggaggatggtgaaatgcattttatcacgtcagatcacgttcagttagattatacggatgaaggccaggggcagccaatcgttattttgacgggatttggtggcgctaaggatatttggcgcgctcaaatcccggtactgattcaggcgggctaccgggtcattaatttagatgggcggtgccaaggtttatccgagcacacggcgaaaggcttacgtatgagtcgtcgcgcggtggatgcgcatgaattgattgaaaaattacaactcgaacaaccaattttactcggtaattcgatgggggccgcgacttggtttgcgtacgtgtcattgtatggtgatacaggaattaaggccctgatcgacgtggatcaaacgccgcggatgatcaatacaccgcactggcaatatgggttcaaacaggttcaatggcaggatattccggactattttagaatgccgctgggacactcgacgtttaagcacatcgatgatgcgacgtatgcgcgcgtcaaggcagtagaagcgcaggcaccgttcgatgcgaaattaatgtttccattgttggttaaccacgcggttcaggattggcgggatgtgatccgccaattgaccgtaccgttcttgatcattgcgggcgccaagtcaccgttcttcaatcccgactttgcggcagtgactgctcaaatggcactacgaggacagagtgtggtcattccggaagctggtcatatcgtgatggcggaacagtcggcagcatttaataaggcgttgttggaatttttggcgacgtgctaggtcgtggtcagtgagtttccttgatgcattattatttttaaaattatagttatttcaaagtacggtggtgataacattctttgtgtcatcaccgtatttttgtctatagtaataggtcgctaattttggcgacacgacaaagattatatatttaatacattaatattaaagaaaataattaagactgcgcttacaatcgttgctaggattaacttttgcttgttgcaaatgattatccaactgcgcgataatgagtgcataatctaaaatttatcggaggatgtataaatgaaagaaccatacggtgtaggcttggatattggtacgaactcggttggctggacggttgtggatgcaagtggtcatgtcagaaaaattaaggggcagactgggattggtgtacggttatttaaagaaggggcagccgcagcagaccggcggggatttcgaacaacgcgtcgtcggttgaaacgggtgaaatggcggttacgattactacgcgaattctttgaccaaccaatcagcaaggtggatatcaatttctttgcgcggcgcaaatattcggatatttcacctcgtgatcctaattataacggtcttgaaaaaacgttgtttaatgatcggagtgatcaggatttctatcatgattatccaacgatttatcatttacgtgaggcgctgatgactcagcaccgcaagtttgatgtgcgtgaaatttacctagcgattcaccatattgtcaaatatcgcggcaattttttgcgtaatgatgcagcgacagcgtatcgaagtgggacacttgatttacagcagcactttgaaactttgaatcatttgtttagtcaggctgatctggagctgaacttgaacctgacaaccgatgtagcgttgcttgacagcatcaaacaaacattggtacgaactgatatctcgcgtagtgaccgccaaaaattaattatgccactattagcagttttaactggcgcgactactgcggaaaagaagcgccaaaaggcagtggtaacagaatttgcgaaagccctcgttggaaataaaaccaagattgatgtgctgactctaacggacatcgacgctactgaagcaaaggattgggcctttagtttagaggaaaatcaagacaaacttcctggcattgaagaccgttttagcgaagtgggccaacaaattattgatgaggtaattcggttatacgccagcgtcaaccttgcacagcttattccagaaggtaaacggttctcacagagtatggttgagaagtataaacgccatggcgaagatttgaagttattgaaagcgtatattcgctctcagtcagacgccaagcgcggacgggctattcgggcaacctacgatcaatatattgatggtgtgaaaagtaaaaaggtgacgcaagaagcgtttcaaaaggccttgggaaaatttgttgacgccgatgtagatttgaatagttgggcagctcaaattaagcaagctattgactctgaacaattcatgcctaaattgcggacaaagcagaatggagctattccttatcaggttcaacaaaatgagctagatcaaattattagtaatcagaaggaatactacccgtggttgggtgaagaaaatccggtcatcaagcgacgcggtaagtttccatacaaacttgatgagcttgtcggtttccgggtgccttattatgttggaccgctgattactaaagaaatgcaggcagcaactgccaatgcaggttttgcatggatggtacgtaaggctgatgggccaatcacgccatggaattttgatgataaggtcgatcgggtggcctcggcgaccgctttcattcagcggatgcagacgacggatacgtatttgatcggtgaggaagtgctacccgcacgcagcttgatttaccaacgctttatggtgctcaatgagctgaataatattcgagttgatgatgggcaattaacaccccggcaaaaacaacgactatataaccaagtgtttaaaaaatacaaacgagtaacagctaagaatattcaagacaatttagttgcagcgggagagtttcccactgcgccacgaattacggggcttgcggatccgaaagtattcaatagttcgttatccacgtatcatgatttgaaacaggtgttgcctgaagctatgtcagacgtgcgtaagcaagctgatattgaaaaaatcattttatggtcaactatttttgaagatagtacgatttttaagcaaaaactgacagagatttcctggctgacagcggcccaacttaagcaactaggtcaattacgatatcgtggctggggacaattatcacgaaaattattaacaggtctcaaagatgataataatcgttcaatcatggacggcttgtgggagacaaacgctaatttcatgcaattacgaagccaacctgccattgagaatcaaattaaatcggcaaaccaggccaacctaacaacggcggatcttcaagataccatcaatgaattatatacgtcaccgcaaaataagaaggctattcgcgaagtgatggtggtgttagctgacattaaagatgcgatgcatggtcaaacacctaactggatatttgtggaagcggctcgtggtggtggcgttgctggtcggcggacacaatcacggtcaaaacaaattgttgcagcctatcagggaacagctcaggccattgtcagggatcaagtccaacgtgaattaaaagagaaaatcaagaacaaagctaatttcaatacgcggctcgtactttatttcctacaaaatggccgcgatttgtataccggtgatgcgattaatatcgatcgattgtcagaatatgatatcgaccatatcttgccacaatctctggtgaaagatgactcattagataatcgagtactgacaaatgcacgcatcaatcgtgagaaaaatgatacgtttgctagtgaaaagtttgggaaaaagatgggtgctaagtggaaagagatgcaccgaatggggctgatgaccaaacggaagcttgaccacttactgatgcgtcctgatgaaatcagcaagtacgcgactggttttattaatcggcagttggttgagacacgtcaggttatcaaactagttgaagagctgattaatgcagaatatccatccaccgctattgtgtcggttaaagcgaacttgacacatcaatttcgacaaacgtttgattttccgaagattcgtgaggtcaatgactaccatcatgcatttgacgcagccttaactgctttcattggcacctatttgttgaagcgatatccgaagctggaacgattcttcatctacggtaagttcgctaaacagccggttaacctaacacgtttcaatgttatccgaaaactagctaagactgataccccaattacggatatcgatactggtgaagttttgtgggataagttaaccgatattaaatattttgagacgctttatgattacaagcgattattggtgacgcgtgaggtatccgaaaactatggggcaatgtttgatcaaactctcttgaaggcaagtgataatggcaagcgattaattcggaaaaaacaatccttcgatacagctatttatggtggttatacgggaaaaacgctggcttacatggctatcgtgaaagtatcgactaaaaaggatgtccagtaccaagttgtaggtgtacctacaactatggtgacacaaattgagcagttggaacaacaaggaatgacaaacaagcaagcggtgacgaaagtaattgaaccgctcattgctgccaacaacaagaagatgctgacgtatgaagtgttattgccgaaggtacggtttgaacaggtggttcgagatagaattaaaggtcaaacgcaccgcttcgcacttggtactgatacgtattatcacaacattcaagagctgtatttaccattaactttacagcgcgcatttttaggtaagcagaatgagtctgaagtgcaattaaatcagaatttactgactgtttttgacgcaacgcttgcccaggttaaccgatactttccactttacgagatgaacaagttcaagaagatacttaattctgctcgtgatcagattgagctgctggaagcgaaaaatcaatttgttaagaataagctggttttagggaagcaaggaattttgaccaatatgtttattggcttacatgcgaatgcctcgtatggtgatttaaaggtgctaggtgtgaaaacagattttggtaagttacaggttcctggtggcattaagttaacgggtgacgctgaaattatatatcaatcaccaactggtttgttcgagcgaaaaatttcattaaaagatttatagcgaaaaaaagatgtcatcccgataaggatgacatcttggtacatatgtagtggtccgaatacggactcaaaaggtgaaacttggcaataaatgccttgtttgatcttgacgctagtagtcatatcaagaaggtttagaacttgatacaagtgaatagtagcacgaaaaatataattaatcaaggagctgttattatgggatggcgaaacgtgattattacgcaacatgctaaagtttcttattcaatgaatcggatattagttcagacgagttctgataaatatgcggttccaatcagtgatattcaattgctgttagtcggaacaactcaggctgtgattactagcgcagcgctttgtgcgctggcggaagctcatgtcaaagttatttttacagatcatcagggggaaccaatcagtgagaccaacgattattatccgacacggcgaacagctgatttggtacgacaacaggtgacttggcccgaagcacgaattgcaacgctatggacgaaaaatgttggtagtaagattttgaaccagattcaagtcattgactttgtcggtggcgatacccagacacttgttgatgagttggataagttagaactgaatgatgtgactaatcgggaggcagttgtggctaataaatatttttcattgttatttggtgaccagttctaccgtcgagattttagcccaattaacgctgcactcaactacggatacgccgtgctgttatccatggtgaatcgagagattgttttaaatggctatctgacctgcattggtattcatcatgagaacaatgaaaacgaatttaacctcggctcagatttaatggagccttttcggccgattgttgatcaatgggtcagtcaacaacggtttaaggacttcacaccggatattaagattggactagtgtcgttattagacctagagattgggtttaatgggcaccaaacaattgtgagccacgcgattacagagtatgttgcggcgtgcttacactatcttagcggtgaaacggaagaattaaagattgaggtgaaattaccagatgaggtatcgagtgatgcgattaatagtcatgtttgatgttcccatggatacgtcggaagaacgccgtgcatatcggcactttcacaaagctttagtgcgtgagggctttttgatgatgcaatactcaacttacgtccgggtttgtgtaaataagaaagcggccgaattcgtggaaaagcggattgcgccactggcacccaaaggtggaaaagtgcaaacgatgacagtaactgagaagcagtatcaggcaatgcactatattcaaggtacacctagcaatgatgttttgaattcagctgaaaggacgattgttatatgaatataacatattatccattcccaccattcaagatcgatgctggcaaggtcaacgttcttgatttgggaaatagtaacatgtatgccgaagtgtgccaaggctttcgagatcgaattgacagtgtacgtataagcaatgacgaccttgaattacagacgatgagtagccaatgcaactggtatggtgacttgatgttatcagtcgatttgaaccgcctttttctaaagaaagtgcagacccaaattatcaagttaatggctgatgatcggcaagtagcggtcttagatgaaaatcgtaaagtagtttcgcaagtaatggaagccagcttcttactagacttaccgctagatgttgacgaatcgcctagcctagaacaaatattgaaatttaccggtattcactttccgacggagcttatgaatgacccaagggcaatactggaggcactcgttcagacgcatgttgagctgggcttgaaacaaaaactggtgttgactaatatcagccattacttagatcaaaaacaatgggcgagctttgagcaattagtgcatgatttgggcgcaactgtcattgttatcgaatactcagaaataaatcgaatggaaaagttcaaaaatagttgttattattatgttgacgaggatttagtagactggcgtgatatgaattaatgagtaaatgatgttaaaatgctggtcttgaatagtagtcatatcaaacaggtttagaacaacaattcaaggttacaacaactgtaccacgtcttgaatagtagtcatatcaaacaggtttagaacaatcaagtcattgggacgacattttcgattgtcttgaatagtagtcatatcaaacaggtttagaacttaacatggacgtctcatatatcaactatggtcttgaatagtagtcatatcaaacaggtttagaactttgcagaacgtctctaggaggtctgacaagtcttgaatagtagtcatatcaaacaggtttagaacaaccccatcaccgtacaatcgtttgacctggtcttgaatagtagtcatatcaaacaggtttagaaccagcactcgttcagataattaattactggggtcttgaatagtagtcatatcaaacaggtttagaacatctataaagattacacaatggagcaatatgtcttgaatagtagtcatatcaaacaggtttagaacagagttaaccatttgaattgcatgaaattgtcttgaatagtagtcatatcaaacaggtttagaacaacttaatgaaatacagtccggatacgatggtcttgaatagtagtcatatcaaacaggtttagaactgctcgccaaccttccaagcagtaccatccgtcttgaatagtagtcatatcaaacaggtttagaacttactaagcctaccgcaaacagtaccgtgggtcttgaatagtagtcatatcaaacaggtttagaacacaccaacctatacaacggaggtgttgacggtcttgaatagtagtcatatcaaacaggtttagaactaatctccttttagaatggtaggtcgtcgtgtcttgaatagtagtcatatcaaacaggtttagaacaaaactgcaagcaaggtatcgagctgtttagtcttgaatagtagtcatatcaaacaggtttagaactaggaggtcaataaaaatggataacgaagagtcttgaatagtagtcatatcaaacaggtttagaacattaatgtatcacgtattgcgacagacgctgtcttgaatagtagtcatatcaaacaggtttagaaccagaccaagcccaacaactacaactaattggtcttgaatagtagtcatatcaaacaggtttagaacaaactcaggtagtaccagcgtatcaacgagtcttgaatagtagtcatatcaaacaggtttagaacaaaactgcaagcaaggtatcgagctgtttagtcttgaatagtagtcatatcaaacaggtttagaactaatctccttttagaatggtaggtcgtcgtgtcttgaatagtagtcatatcaaacaggtttagaactggcctcattgattggaatatggcgctcatgtcttgaatagtagtcatatcaaacaggtttagaacattcgataacgaaatactcgtcgtgccgttgtcttgaatagtagtcatatcaaacaggtttagaatcattacaacttaatgcgaacgcacaaccgggtcttgagtagtagtcatatcaaacaggtttagaacaatggcaatttgataatacctggacttcaggtcttgaatagtagtcatatcaaacaggtttagaacgcggcaagtaatcaattaggagggcgtacggtcttgaatagtagtcatatcaagcaggtttagaatagcataatgtattatataacatattatgttgtcttgaataacggccacatcaaaaacagtttcacaatactaaaaaaggctcaccaactaaaacaggttggtgagccttttctatttattaactaattactaatcaatcacgccatcttttcccatccatcggaaccgaataaacttcccgacctcggtcacaatcaagacgacgatcccacagataatcgggatgccccaaccataccagaagttgatgctagtcgtatggaagacggattgcatgaatggtaggtaaatgattcccagttgtaagagaatcagaataccaatgatgtagaacgccatcttattttggaagaagtacttggaaatgacggggtggtcattccgcaagttgaagaggtagaaaatcttaccaaagatgatgatgttcagtgacatggtactaccgacgacatttggtaatccaagtgcggtcaagtagttgtaggcgaagatccccaatccagaaattaggaaggagacatagccgatttcaaagtaatctaattttgacaacaacccagacttaacattccggggaccccgggccatgatgccggcctcgggtggctcaaagatgaacgcaaactggatggtcagcgcggacaccatattgatccacagtaattgcgtcgggtacagcggaagttcgtggcccattaaaatactaatgatgacaacgaggccttccgcgaaactagttgggagtaagaagcgaatcgtcttacgaatgttatcgaagacgtggcgcccttcacgaacggcggcgacgatatcagcaaagtcatcatcggccaggaccatatcggcggattccttagcaacttcggtccccttgattcccatagcaaccccaatatcggcttgcttgagggccggggcgtcgttgaccccatcgccagtcatcgaaacgacgtgattattggcctgttgggcacgaacaatccgtaatttgttattcggtgttgcccgtgcgaagacgttataatcatcgatgtgtgcttgtaactgctgatcgtccatcgcgtcgatttcaggaccagtaatcgctttgacattggcggccaagttcaacttgttggcaattgccatcgccgtatcagggtggtcccccgtaatcattttaacttgcacgcccgcttgccgtaattcggcgatcgcggtagccgcttcttcacgaggcgggtcaatgattccgactaagccagctaaatgcagcccaccaatggcttgtgcatcaatggtagtcacgtcatcatcgacttcttggtaagccagcgccaccacgcgcaaaccatcagcggttaagtcgtccatggcatcatcccagtatgccgtttggttagcttggtcagttaaacgcaggacagtcgcgggtgagcccttgaccattagtaagcgttgaccatctaagtcggccaggcgagcagaaaaacggaaggcggaatcgaatggtagcgagtcaacttcttcaacctcaggatcatgaccagtcattttacgatacagcgtcgtcaaggcaccatcggttggttcaccggtcagttcccagcgattgttttcgaagtgtagctcggcgtcggtcgtttggccggcaatcttaacgagccattccatcgcgttatcttggtgccagtcgactttgttgccattgagcttgagatggccatcgaagttaacgccaccattatcatcataaccgacccccgtcacatcaaacgtatgctcaggcgtcacgaccttagtgaccgtcatttcatttttcgtcaacgtcccagtcttatcggtgttaacgatatctacggcacctaaagtttccacggcgggtagtgacttgacaatgacgtttttcttcgtcatctgccgggttcccatggctaagaccaccgaggtactagcgggcagtccttctggcatagaaccaacgaccatcgtaataaccgcaattagtaaagttggcaaactataggtatccatgaccattcctaataggaataataggacggctgccaccacgatggcgatggataagccaacccccagtgagttcagattacgcatcagtggggtagtggtttgtttgacgtcactaacagactgctggatatgaccgatttcggtatcttcggcggtagccgttacgattccaacggccgaaccgctagtcaccgcggttgacgcgtaaaccatattcttacggtcagccaaagccagcgtggtctctgtcatcggttcttcttgtttctccacgggattagtctcccctgtcagcacggattcttggacgttaaagttgtccgctgaaatcaagcgcatatcggcaggaaccgcgtcaccggcttctaagttgactaagtcaccaacgactaattcgcgggcgtcaatttccagttttttcccatcacggatgacgaaattcttggaaatcagcatttcacgaatccgttctagcgcgttgccagcttggcgttcttggacataaccaatgatggcattggcaataataaccagtccaataacgatagaatcggaatagtggtgcatgaagaacgttaagaccgctgctgcggctaaaatgtagataatactgttattaaactgcttgatgaattggacgaaccgagacgtacgcttggtctccagttcgttgcgaccgttatgttgtaaacgttcggcagcttcagcagtgctcaatccattctcaggatcggtggcgtactttgcggctaaggctgattcatcaagctgccataagttatccgcatcgggagggttctgggtgtcgttttgctcttcattagaggttaacgactgattgtcatcttttatcattcaattcgctccttaaaaataaagttattaccggtgaggttctgtaaaatcacgacgtttattgcgtgttaaataggccaatttcgccacatcctttcttaattagcgttattataaataatattatatacgaacaatctaggtgaaagccattaaaacatttgacaaattcatgacaaattattgcgttagttgcaataatatatcagattttggctagtttgtcgctgaaaatgactggttttcctcgaattgttgggtaaattaaatagggagaacttaagatgacagataagttaacgttattgcaatatgatccaaatccaacggctatggtagggccagacgtggatggccgctttactgttccagctaagctactctacatattttctggtgatgattattttcaacaattcgtcactcggtatcatggtcaccgtttaggccaatttaataccattactaaagttagctgggtttatcaaatcggttatcgtggtcaaaaattggcagtagcgcaagcgccccttggttccccagctgcgacaatgtatttagagatgttgattgattttggtgctcgtaccgtcatagccgttggtagttgcggcgcattaacagcactaccagaggaacaattattaatcccaacggtggctttgcgtgatgaagggacgtcctttcattatttagcagcagctgattgggtgccactcgatccaaaggttatacaggtactcgggacaacattgacgaaggcttgcctgccatggcagatggtcaaaacgtggacaacggatgctttcttccgtgagactgtgtctaaagtcaaagctgctcgtcagcagggttgtcaagtcgtagaaatggaatgttcggccttagctgcctgttcggcgtttcggcaagtttcctttggacaattactatatacggcagacaccttagcacaactagagcactatgatccgcgacattggggtgcgggcggtgttcttgctgccattggactagctgtggaaagtttggccgcatattagcgaataaaaaacgagcagtcgatgactgttcgttaatagtggctaatccttgatggggtccttcattaataaccagagaatcaggtaagcgatgataccagggaacatgggtgtaattgctaaaacaacaaataatagccgggtaacgttagtattccagttaaaatgttcggcaattccaccaatgacaccggcaatcacccggtccgttgcggaacgatgaatatcgatcttcataagttaattcccccttaataatgctaactataatgtagcaggtttgattcaataacgctactaatttaatcggttggaaacggcgtagtggtaagaaccgtggtatagtaggtgatttcggtcaaagcttggtgaagtgcatgatcgtagcgtttgctcaggggcgcgttatcgataaagtgaccgttactttgaagggtttgtggtacgttaccaatgggcgttggtttagggaggacgaccattcctaatcgttggagaactggaactagtgcggccgccccaaattgaccgccgcgcatattgtcagaatatgagataatcttagccggtttacgggcgccttcgaatgccaaaaaatcgaaggcgtttttcaatccagctggcatcgcgtgattgtattcgggtgtcaggataatgtaaccgtccgcactagccatatcggtgagccattgctgctggttagcaggtagctcgcggtgcgggttcgccatcggtggctcgggttcatcgaaaaggggaagctgatagttggccaaatctaaaaattggtagtgaatcgtagaatgagtcggtaattggtcaatgattaattttagatggttaaataaagcgcggccgttagcctgtgaccgggtactccctaagatgattgcaattttaaacatagtgggacctccagatatttttattgattctaatgaatacaaaatgatagtatagacttaataatattggcatgcaagtatttattcaattgaattaaaaaggagatatttaaatgacaacaccattagttagtcagttgatgacggaactaaatcaatttttgacgcaggatagcgttgatgatcaagaaaaacgctgggccatgcaacaaacgattgatccgcaattacaagcggcattaaaacaactatcgacgacggatattaaaattattgcgtatctgggacggcgtggtgccagtcgagctaagtcgctaccggcaccaacggaactttcacaggcgacgatttctcgcggtttgactaaattatcccgattgaaattggccacgaaatatcgggatttgaccaataacaaagaaattctcgtgcgattgacgacgctgggcgaagcagtcgctgatttacacacgcaactggacgcggccattgctgctaaagcacaagccattgctgatgactattctgacgcggaactgagacgctttgttagcctaatgcgacggattcgtgaaattaaaatttagcactccggttaaacgagtgctaaattgttgcattcccacaaaatggtgttagtatatatatcgaaggtcaggaaaggtcaaacaagaatttgaattactgaccagtattaatagccaagtgaaattttgaaaggggattgttagtatggctaatactttaatgaatcggaacgatttcggcatgttggatccgtttgaacggatggcacgctccttctgggcaccattagaaaacatggatcaagtattgaagaccgacattaacgaaactgatgatcagtatcaagtgaaggttgatgtccctggtattgataagcaagatgtgaagttggattatcgtgacaatgtgttgtctatcaaggttcaaaaagatagctttgtggatcatgaagatcaagaccaaaacattgtgatgaatgagcgtcatactggcaccttgcaacggcagtatatgttaccaaacgttgcggcggataaaattacggcatcccaagctgacggtgtcttaacgattacgttacctaagacccagccgagcgcgaatgacggtcaaatcgaaattcaataattaaatcattaaatcatcagtaacaagtgagcggcccaccgataatcaaatcggtgggccgtttttgacatcaacaatcggtatgaattatgaccgctggttggtaagctgttggtttagctggatgactttgatgcgggcgagtgccatttcaattaaccatagaccgatataggctccggtgtaaaccaaggtatagaagccaaaccagcgaacgtttaatggaaaccagccacagagaatcgcaagtggggtcatccctaggtaagaacacagacaatgagcaatggtttgtttcgtaatcgaccacgtttcaatttcgaatagccagctactgaatgcccaaacttcaccaatcagaatccacaataatgtcgaaagctgggtggcggctaagggcgaggaccagtggctgacaaaagtgggattagaaggaaataaataggtggtattaaagaaggttgagaaccccaaggccattaagtagccgataacgatgcctccgatggcgccaatcaaaagggtgtgccaaagtcttttcataattgtgccgcctttccaatttgttgggtatagcgtcgtgatgcgtatgttgttgtgccagttgttaggttgacttgaaagctaccccatttggttaaggtaaaatttttaatacaggcgattcgcacaatttcactactagaaatacgtagaaattggtggggtggcagttggtccattaaagtgtgtaagtggctgtgaacgaggtaagtaccagtggttgtttcacaataaagtcgtttattggcagtgtaaaaacgtgacaccgattgaagtggcagcttaatgagcgagcgatcttgaaaaacattgatgaatcgtttcagagatggttaactggacgtgcatcgctgattccccccttaaatagcgattttgataagcttattgtagtgaaaaatgcggcttgacactagtgcttattgctacttggtcaactaaacgggctaactggtcaggaaatatgacaaaaaatttcccgggaaataattgtcactggtggtcgctaaatatgataagctaattaacggtataatacttactgaaaattagtgtcagttagatatggagatgacgagcgtggatgacgcagaacgtgaacgcggaccatggcatcgtaatttgattgttttatggttttgtacgttcgttgcgggaatggcatttagcgaaattatgccatttctttcattatttgttagtcagttgggtgatttcacgaaggcccagattacattttatagcgggttagcttttgcagctgattacgcgatttcagcaatttcggcaccactgtggggcatcattgctgataaaaaaggtcgtaagatcatgctattgcgcgcgtccctagggatggcagttgcgatggggttaatgggctttgtaacgaatgtctggcaactagttgccttgcgcgcgctacaaggtgtgtttgcgggctttatttctaatgcccaagccttagtcgcgtcccaaacgccacgtaaatatagtggacgggcgttgagcaccttgatcactggtgccgttagtggtcaattgtttggcccagtaattgggggcttgctagcccaattgttttcgattcgaaacacgttttttattacagccggattattaatggtggcgtttttgttgagtctgttctttgtacaggaacacttcaaaccagtcgcacatcatcgtgaaccaggtgacagtcgcaatcctttagcagcgtttcaaaatccgcgcttgattattgtgatgttatgttcgacggccatcgtccaatttggaaacgcctcgattgcaccaatcattagtttatacgttcgtgaattgatgcattaccgtggcccgattacggttgtggccggaattatcgcagctttaccgggtatttcaaacatcttttcagcaccgcgccttggacgttatggtgatcagcacggttctggtaaggtattgttatttggctatatttttgcggtgattatgtatttcccacaaggcattgttacgagcgtcgtggccctcggtattttgcggtttgccattgggatttccgatggcgcactatatccagaaattcaaacggttttgactaagaatacgccagtacatcttacctcaacgatttttagctataatcaatcttttcaagctattggcaatatgttcggcgccttgctcggtggtttggtggctggttggttcaattacaacgcggtattcattatgacggcgttacttttgttaattaacctaggtttaattttgtggctagttcctgatatttggaagaacggcaaacggacagtttcctaggtgtttggtagttagtctattaaattggctagctgccttttttgttacttgtccttgaatatgatgttaattcggtgtattgttagtttcatgaatatcgaaataagtaaacaagatcaggctgatcagcaacgagtggcgattttcaaagcactggccgacgctaaccgattacggattatccgggtgctctatcaagcacaacgggaaatgacttgcagcgaagtgggggcgcaattaaatatcagcaagtcaaccgtctcttatcactttaaggccttgcggttagtgggtctcaccaatacgcgacgagaagcacagacgaagtatctatccttacaattagcgacctttgaccggtttttaccgggatttttagcaacgctttagtttttttgctttttagttcgacgattatcgaactaaaattttggaaagaagatgtcaactacttatgaccacaacacatcaacatagtcgctacttaacacttggaatgatgttagcggcaacgaatatgcgtttaccaattacaatgatgccgggattaatcagttctttgaaacggacactgggtttgccgagctcgatggcgggattactgaccacgattccattattgacgtttgccattatgtccccattgattgcacattgggggcggcgatttggcaacgaactgataatttatgtcatgttgatctttctagccgttgggagttatctgcgggtcatcccaacgattgcggcccttttcattgggacgttacttgtcgggattggcgcggacggtggcaacgtcttgattccagcgattattaaagataattttccgacgaagattccagttgcaactagtcaatacacgctctcaatgctattagtcggttcactgggaacaggactttcgggagtgttggcggcacactggtcgttaccactaacgatggcggtgctatcggtgattggactaattaatttggtcgtctggttgccaaacttgaaatataatcatcgcgcaccaacagttgcgatgaccgcgagtgatgggcagtcaacggcaactcacgggagtgtttggcggcggccgttagcgtgggtcgttacggcctttttcggcttgcaagcactagtctactattcattactgacttggttaccaacggtatttgttgcccacggcttctccttgattgtggctggcaatttagttacggtcatgcaatcgagcggcctaccgatgtcatatttagtgccagcgacttctggtcatcggcgcggcgtttgggcaatgattatggtggtaggtgtcggttttattgcgggaattggtggtatcttactttccggaacgagtttttgggtggcagcactgtcctgcgtcttgctaggattaggatctggagcagccttcagtttggcagtcgtcttctttacgcaaaaaacgaccaatgggtttgaaacggctgacttatctggtatggcccaatccgcgggctatttgttagctgcagtggggcccgtactattcggctggttaggcggtcaattaggctggggaccagtactctggttagctatcattctttccgcgttactagcattatccggcagcgtcattttccagcatgcaacgatttatgagtaattgatatcacaatgatgcagaacgagattggccaaagtcaatttcgttctttttttggaactttatctttgccttagagttactctaagggactacactaatctctattcaattaaggaggccacagtaatatggcggttattcaaattctaacggtcgtcggcgtggcgatcatcggggcaagccttgtaggtgatcctactcagcaacgacagtcaaaaccagtaaaggagcaaaaataagatgacagtgttaacaacgatgtatcacctagcaaatggtgtcaacattcccaaagtcgcattcggaacttggcagatacctggtggtgaggcaacgtatcaagccgttcgtgcggccttagcagcgggataccggcatattgatactgcactggcctatcaaaatgaagctagcgttggccaggcaattcgtgattctggcattccacgtgagcaaatctttgtgacgactaaattaccggccgaaacgaagtcatatcaaggtgcactaaatgatttcgatcgctcactgaaaaatttgggtttagactacgtggatctctatttggtacacgcaccttggccatgggggcaagtcggtcgagtttacgatgaagctaacctcgatgtttggcaggcaatggaagctatttatcaaagtggccgggcgaaagcgattggtgtctctaactttgctgttcgggatttgaagaatattcttaaccaggcgacgataccaccaatggtcaatcaaattcaatattacttgggcttcacggaacctaagatcaccaagttttctgaggaacatgccatgcttgtagaagcatactcgccgttagcgacgggcggggtcctcgataatccgcaagtacaggcctatgccgataaatacggtgtaagtgtggcgcagttagcgttacgcttcattttgcaaaatggggtcttgccattgcccaaggctgttaatccagcccatattgaggcgaatacgcaattggacttcgcaattagtgtggccgatatgcaagccttaaacgacttgccagatgcggctggttcatacatgcacaacccaacccaaggttaacgaacaaaatgtttgaccgcacttgggtcgataggagtaaactgaacataattaataaacgataaggagcgatttgatgacaacgattaatgcagctaacgcgggtacttacgcgtttgatgatcaattcaaagttaaccggatgggttatggcgtcatgcagttaacgggtcctgggacatggggaccatacgctgatcctgaaaatggggtcaaggtagttaagaaagcactggaatatggcgttaatttctttgatacggctgattcatacggtccatggtttgctgaccggtacttagcggcgggcttgaaggatgccgctaatcgtgatcagatcttcatttctgataaggtcggtcaaacgcggcaaggaccgaatgtgtggacgccacttggtgagccacggtatctgcgtcagcaagtagaagtttcaatgatgacactggggattgaccatgaagacctagtattcttacatcgaattgaccctcattactcgattgcggatcaagtcggtgaactcaaaaagcttcaggatgaaggtaaaatcaagcatatcggtctgagtcaagtaactgttgatcaaatcaaggaagcgcagcaagtcgctaagattgatgccattgaaaatctctataatgtcgccaatcacggtgatgatgacgttgttgactacgcggcctcacaaaagatggcttttctgccatggttcccattagcaacgggtgaactggctcaggctgggagtgtcctcagcacgatggcccaaaagtatcaggtgagcccagcgcaaattgccttggcttggctattgaagcggtctgataatatcataccgattccaggaacaagttctattgagcatttacgggacaatgtggcagccgccaacgttgatttaacaacggccgattttaatggattaagtcaattaagtgttaaatgagtatttaggtcgggaattcccgacctttttgtttgcctaaaacgagctaaacgacgcttgaaattcatggggttgacggttaaaatgaataaacattgaatgagaaagaggattgagcaaatgagtacgcgtttgatgagtgatgagccaacaatttatttagcaggaccttggtttactgagggccaaccagaacggctagctaagatcgaaaaattaatggacgagttagaattgacttattacagtccacggctagacggcatcgatttgacgccggatgcgaccgaagctgatcgaaacgcggtatttacggacaatgtggaccatttaaaacgggccaagttagttgtcgccgtggttgatggctttgacacgggaactatttgggaaactggaacagcatatggtttagatatccccgttgcttactatggtgaaacgttagctgatggcacgtttaatgtgatgctggctaagtccggcaaagcggttattgagaacatgactgatttgaaggcttttctacaagatcccactgccgatgattttcaatatacaggaactattcgttaatttgaacggttagtcaaaataaaaagcgagccgtctgcatttgtcaaggctcgctttttgcatacataaatggcagaacttgtggtgggaatgagccgcttgaaaaaatgtaatatttgttaaaggcaatgtgtttaattggagaaaagtcatcaaatggtgttacgctatgggcagaaattggttgactagcgcaaatattaagaaagcggcaagaaaacaaaaaagttcagttcaaactagacaatcactatccaagttgtataatgtacttgtaagcgttatcagaacctaattacctattttgggggcgttatttatggttaaaagtaaagcaattatgattggtgccgggctatcaaatatggctgcggcggtctacttgattcaagatggtcattgggatggtaaggacatcacattctatggtgttgatatgcacggtgccaatgatggtggtgccacgactgattttactaatgagtattggaataagaatcatccgatggctaacacgactgggtatgttgcccggggtggtcggatgctgaattaccggacgtacgttgacttaatggatttattggaccggattccatcggtaactgaaccggggatgacggcggccgaagatacgcgtgattttgatgcgaaacatcggacgtatgatattgcccgcttgatgcagggtggtaaaggcattattaatgctggtaagttaggattcaataataaggatcggactttgctgactaagttgattatgatgccagatagtgaagaaacgaagctcgacaacgtttcgattgctgagtacttcaaggatgatccgcatatgttccaaacgaatttctggtatatgtgggaaacaacctttgcctttagaacgcaaagctctgctcaagaactgcggcgttacatgcatcaaatgatttatgaatttacacaaattgaacacttagttggtgtcaaccggacgcgttacaatcaattcgaaagcatgattttgccattaattaagtacttgcaagggcaaggtgtgactttcattgataataagattgttaaggattggcaatttaaagacacgccaatgcaagacgaaattacggtgactggcttagtcattgaggatgcgcagactggcgaaacggaagaagttgaagttgatgaggacacagcggtgatcttcactaacggttcaattaccgattctgcaacgatgggtgattacaacacgcctgctcctgaaaatatggattatggtgttagtgctagtttgtggaagaaggctactgagcggttctataacttagggacgccagataagttcttcaacgatcggaatgctagcgaatgggtcagcttcacgttgacgactaagaatcatttgttcttaaatgaaatcgttcggatcaccacccaggaacccgggaatgcgttgaactccttcttatcaactacgccaattacgccgttgaaccaaaaggatgttaatatgtctatcgtggtgcaccaccaaccacactttacgacacagcaaccaaacgaaacagttctgtggggctacttcttgtatccacggcgtcaaggtgagtttgttaacaagccgtatatcaagatgacgggtaaggaaatggctcaagaattaattggtcaactttccaaagtagatccgggtccaggcaatattaaggacaaggaaaaggaaattttggacagtattgtgaacaatattccggtatacatgccatatgcttccgcactctttaataaccgggctaagtctgatcggccagaagtcttaccaaagcactcaacgaacctagcctttacgggtgaatttgcggaacaaccataccagatgatcttcacggaacagagtgcggtccgctctggtgagattgccgcttatcactttgctggggtcccaatggataacttggtcaagacaccacggtacgataaggatccaaagaccttgctcaaggcaactaagaagatgtttgattaattaaatgctggcctgtcagtggttaatgctgatgatggcatgatttaaaaacgctccccatgaaagatgactttcatagggagcgttttagtgtgcatcacgatcagtagtaacggctcgttgagacgccgtcattaacaggatcaggttgctaagcaatttagtggttgatcaaattttagcagctgctttaggtgttaatttagacggtgtgtgtttagtagtggttttgaccgtgagatgctttttggttgcaagtttgggtgcctttttagcgttttgcttggcggtctttttgattaattgtggtgccatcttcttagttttcgttggttgggctaacgtttttttagtggcgagagtcgttacctttttagttggtttgatacttgccttagggtgcttgatcgttagcttcgttgattttactttggtggtcgtctgctttgtcaatttgattacctttttagaggttttgattttaggcgttgctttcttagcactggtggctttaggtccagcctgcttggtggtcttcttagcaattgtcaacttagtcttcggggttttcttggtcgcttttaatttagcggttggggcgttctttttaatcatcgtggtggctttagcccagccgagggccttaccgtgttcactaatgaggtaatatgtggccgacgtatgtttgccggttgctaaagtaatcgtcttagttaccgtgtaagtctttttagtgctgagttttgctttggccgggctaacaaaggcgattgcctgatcggcggcaaagtgaattgtattcaaagtcgtggcggccttcgcgtgcattgtgatggcggggaggtgggtcgctttagtgagtgcatgggtagtggcttttggggttaccgtggcggcattagccgtggtggtcatggcaaacgggctggtagccaatggtaatgccaaagcaagtgttgcaacgactgatgttaattttttcatttcaaaatcccccttaaagtgaatcttttttgattcgaagatagtttagcaccttgactgctttgcaacaatcgtaatatcaataaaattatcaaaaagtgggtgaatttgaatgcaatcaataaaggcttgataacaaacgaaccgcggtgggagtaaccgttgggttaatgagagtgagcgagattttagaactaacgttcgcactgaatgggaaagttatggtatgctagaacggtatttttactgaaaggggtgggcggcattgccggcagcaacaactttaataacccccgctgaaaatcgtttctttctgttaagtgaacgagctcgacggcggaccacgctccaacaaattagtgcgttattacgtgcacacgtaacggtaaaggctgacagtgatttcttgaaaccgactgtgcgtaatttgatcttacaagatcatggccagtggttgaccgactgtagtcatgagtggcaacttttggcgagtttgccgtacgttgttaatccgaatgaaagccgacaagcatggcatcattgcgaattgtgtcataagccggttcgttatgagtaccatgttcaaaacaagcataatcatcgtgagttgattgtcggttctgaatgcgtcaaaaagttcatgaacgccgaaacacgttacttgatggtgattacaactgaagataacttttatgcggtggcccagtatcagacgctgactaccgctgtaccaacagtgccaacgatcatgtttgcccagccatggctaccacaattaccggctgagcaagccccccaagcacgcaagttgcgacaaacaacgacgcaaaccgtcacgacgtacctaaaacgtcgtaccaagcaactaccattacaggaactaaagcccgctgaacaaacctatcagcggttagtccatgatgaacaagcggtgatcgaagcggctgagcgggcggcccgtcaagcaattgtgaccaatcaacaacaacgccaggcacaagcgcagcaaagtgctgtgaaggccgagcaaaccttgcgccagagtcacgcctatcaacgttatttacagcagctggcggccattatcgtgatgcgtccggagcgaccgatggcgaagcaacagtttgaaaaaatcacgccaccagtgaccgagcgccctttggtgaactcttatcaattcgggcaaatggtgactgaataccgacagactgggaagattcaagttcggcgcctagccatgcttgatcatcagtttgttgccgcacttaatcaggtgactcaacagctagatgaacaacaaacgacgcgtttttatgacgatgtcttcaatagttgttggggctggcagtatcatcagcaggcgacccaacgtgcggattgggagcacttattgacgacccggtggggccaatcattgtcgctggcttggtttgaacaattagccatgcaaacgacgatgccacaaactcaacagtggtttgcggacaatgcggattccggtatgcaagcagcactacagcaacgtttggctgcgcatgaagaccgccaaccgattgcccgtgaccggatgactagatcggaattacgacagttttgtttgcgtgaacagccagctgcgccgacattagaagcatttgaacaggtctttgaccaacagtatcaattgcccgtcgaccggcaagcaacggcccatgaaacgttagcctattactatattgcgcgtcaatatcaaggtgaccatcagcgtgcgttacaacaactgaattggttattgaaagtctaaatgtttcacgtgaaacataaaaacgcccactgattttttcagtggacgtttttaattcggctgacaggttaactattaatgacgctgtgatagcgcgaggctgcaaattcatacagcggccggctaagtggtgtgacctcaacggcttcttcaaatggtgccgtaaccatggtgtcgtcagcgtttttagcgagttttacggcccaagttggatcataaagtaattgttggcccactgcgactagttcggcagtttgtaacacagtcttgacatcgtcgcgggtccggacgccaccaacaccaactagcggcaatttaccttgtaacgcttcgtgcacataggtcatgatggatttatcttgatactgcgggtctcgtgaaacacggtcatagttgttgagtgagacatgaacgtaatctaatcgactttcccgtagttgtgagagtaaccaaagggtatcttcaaaacgaatacctggttcttcgaattcttctggtgagaaacgatagccaacgatgaagggccggtccgcatattggtcaacagctgcaaagacggcctttaataattcatcaataaagcggaaccgttcttgtggcgtgcgaccaccgtattcatcggtgcggcgattactatgtggtgagaagaactgttggatcaaataggtattggcaccgtgtaattcaatcccatcaaagccggcttgaatcgcgcgccgagttgcttcaccgaatgccgcaatcgttgcgtggatctcgtcaatcgacattgcgcgtggggtctccgcatcgtcacgaagggccgcaacggcactggcagagacaatctgttcgccatttaagacggctcgatgcgtcattcgaccggcgtggaagatttgaacgatagctttggcaccttgactttgaatgccatgagcaagtgcacttagaccgggcagcatcgtgtcatgcgcgatactaagctcgccatgccaacccttaccgagatcttcgacgttggcagcacccgtaatcacggcacctaagccagtagctcgttgtgtgtagtagtcgatttcgtcatgggtgatactaccattgtaaaagctttgagtcgtcgtcatgggcgacatcattaggcggttgcgtagtgtaacgccagatttgaatttgagtggttcgttaaaactagtcacaataaaacatcctttcaagctagttttgcttactttttgtaagatctagtttcagtttagcggttgaaatttgttttttcaattttaaagtcgctggttttagttaatattggcataacaggatggtgcgtgtggaataaggggattgttgctgttgttaagtcaggtgaggcttgataggtagatgcaaacaaaaaacttcatcgataagcatggtcgacgaagttttttggaaaattatgatgcaacgttatgccttaaacggattccagaaacggccaccgttgaccttaaagagggcgatgccgaggatgatcagcagagcaactaacgttaacgccagatagtcgttacgtttaaagcgttgggccatgtaccatgtgcgccgttttcccttaccgaagcgccgcaattccatcgcctgactaatggtttcgattcgatctaagcttgaaaaaatcaatggaagcagaatttggatgccgccacgaatacgggtcataaaatgcgcttttttcgacatttcaaacccccgagcctgttgtgccagactgatagtacggtaatcagcttgaacgtctggaatgtaacgtagtgcaatcgctacggaatagctgatacgataggaaataccaatcttattgagactcgcagcaaattcgctgggattagtcgtcatgagaaaaatcagggcgagtggcacggcaaacgtgtactttaataacaaattaaattcataaaaaagttgttcggctgtcaagttaaaatagtgatcagcagatcccagtagtaagtgttcggtaccataaatcgagacgccgtaatgaggcgcaaagacgtacaccatcactaagtttaaaacggaaaaaccaataataacgttaagcacgaacgcgatatcgcggtaatgaatttttgaaaagcggaatagaatcagtgaaaaaatcatcaccccgattaagtaacgcgtgtcgtaagtcatcatcccgataactgataagccaacaaagcagagtagtttagtgctaccgctaagccggtttaaaaaagtatgacggtcgttgtacccgatcaataattcatgttgcatcttagcgcgcctcccgttcagcctgaacaaattttgcgacgaattctgtcgggtttaaatggtgcgcttccgccagggtgtataaacttgtcttggctaaggaagcttgctgaataatggatgcgttggtcaacacatcggctgggcgagcatccatcaaaatgttgccgtggcccaacacaatcgtgcgatccgtgtattctagcattaggtgcatatcatgcgtgatcaacataatcgtcatgtgttgttcctgattgatcttagttaagaaggtcatcatttcagtatagtgttgcaagtcttggcccgcagtaggctcatcaagaattagcatggctggttctaatacgaggatggccgcaatcgtgacccgtttcttttgaccgaaactgagcgcagaaataggccagtggcgaaactcatagagaccacagaccttcagaacggcctggacccggcgctttacttcatcgtcagcgacacctcggaggaccaaaccggcagcaacttcatcaaaaatcatcgttttagagatcatttgattggggtcctgaaggatataaccaatttgatcggcacgttctttgactgattggtcagctagggaatgaccgttaaatcgcattttgccggactgtggcatcaaaaacccagtaatcagattgctcaatgttgacttaccagtcccgttttgacccactagactaatcatttcaccctgatgaagcgtgacggtgatatcgttgatgattggtttggcgggatcgtacccgaatgtcaggtgctcaattgcgagtaacggttggtcatgaacggtgggcgactgtagttgtacgccggcggtccagttttgcaacgtcgcggtgaggtcgggtacttgtaaggcttggaggttatccaagtgttggcaagttgttagatcaacaccggctagtttgagcgctgaaaggtataatggttcgcgcagcccgagttgagtcatgagtgattgccgcaaaatcgtttccggccggtcgttagcgacgatcgcgccgtcttgcatgacaatcagccgatcgattggttgctgtaacacgtcctcgatgcggtgctcgataatgatgacggtcaggtcctgcgtatgagtcagttgatcaatgagtgccatcgaggctttacccgatgccggatcaagactcgctagcggttcatcaaataataggattttactattgtcgatcagaacaccagccatggcgacccgttgcttttgcccaccagataattcctgcgggcggtgagtcaataagtcttggaggtttaaagtttgggcccactgttcagttgcttgtcgcatggccggttgggtctgctgatcattttccaatgagaaagccatatcttcgacgacagtcaaaccgacgaactgactatcaggatcttgcagtaccgtaccgacgtcttgggataatgcaaaaatggagctctcagtaatggtttgaccagcaatccttgcttggcccgtcactgttcctggataggattgtggaatcaagccgttcaaacaccggcctaatgtagatttaccggagccagaaggtccagcaatcaacactttttcaccgggataaatatccagattaatatcacgtaaagttggttccgtttggctattatattgaaaagagaaatttttaaagctaatgatgggtgcgctcatgttattaacgttcctttgttaagctcccacgttgggtccgcgtccgggcgtacaagactagtaggatggtcccaatgatggcaactgagatggaatcggcgatccaagtaatgacaccttgaaggtaaactttgttggccggttcatgataaataataatatcaccagttggtgctaaaagcacccaaccaataaagttgacgatgatttggtaaatgttaaaccagactaattttgccgttcctagtacgccattttcaatcttgagccgatttttagctagtccgaaggcaaccccaatcagaccatcaacgatgacccaagtccaccaaggcgaaccataagttacgaagtcgtttaaggcgtgaccgatgaacacggctaaaccagctgcaacgggaccaaagatggcacctagtaaggctaaaaaccccattgcgacgttaacctgggtattcggcacacccgttggaatggcgacaaatttcatgagaacaaaaataacggcggcgccgatcccggtagccacgacggtacgaattgaattggattgcttgttttgcatagtgtaacactccttaagtattgagaatgaataagttctaataaccattaataaaagcgaacaggcgttaatttcagatcagttatggtcataaaaaaacgcgcctaaaagcgaatgctttctaggacgcgtttgcgtgttaccaccgagattttcccacagggacttatcatgatcgtaacggatcgctccgactgagatggccccagtagcttcttcaagaccatcttcaactaaccacgtcatcgttttgcaccaaaaatacgactctctaagcacgagaattagcttactcatcttgtcacagctttttctaatctgaatttaactattaaagcatacgccaaagtctgtgggggtgcaagtaaaaccgaacggatgtagccggttacatcgagattgaacgggaaaatcgggaacagctgattaaatggtggtcaaatgtgctgattcattcggctatacggtcagtgacggatgctgatgattagttggattggtcgttaattaaacaaagccaataaaagtatatacaaatgatttcaattagctactaaaaggggtaaactagttgacaagaccaaatgatgaaggggatgtgagtagtttggcttataagtatgaaacgattgcggatagtctgcgacaagacataaaatccggtaaatatacgccgggcgaattgatgcccgaccagaataaattagctgaaacttttgatacgacacgaattacgattcacaaggccattcaattactgattattgaagggatggtttactccaagcgcggcgcggggacctttgttcgcaaggactttggcttgactgaacggcgccaagaaacgctggtagacaagcccctgggaacaacgcaaacgaatgccggtaaaaaggtgacgagtaaggtgttggaattacaagctcgcttgcctactaagcgggaagcggaacagttgttaatcgatgagatggatccggtgtacgttattcggcggacccgctacgttgatggtaaggtgtgggcgtatgagcatacgattatgccaacgagtatcgtgacgttgacgaagcaagtcctcgaaggctcggtctacggttacttagagcaacatagtggcaagaaaatcgcgggttcacaccgtattatctcggcagcccgagtgacggctgatgacgttgccgcaatgggcgcgactctgaatgatcccgtgttggtcattaatcagattagttacatggatgatggtcaaccctttgaagtctccgaatcacatttcccatacgagacaagtacggtcgtagcggatgttcaaattcattaaagcaatcggtaaccgcgttaatcagtggctaccgattttttgtggaaattattctggagagttgcattcaagaaaacggtggcccataattaaattgattgaaaaagaaagcgcttcaataatctgattaagggggatgaaaatatgccagctaacttttatcaacgattaattgataagtatgaaccaatgacggaagcagcgttcttagtgttagtcagtgttcgccagccgattaccagtgaagcgattccggcaaaaatcgctgaaatgaccaataatcaactacagctaggattaggaaccttatttacgaatttgcatgccatgacgaaggattatttaatgacggaacgagtcgacgaaaatgacgtgcatacctatgaaatcacggggagtggtgaatcggttttggcggctgaacgaaaacgactgcaattattgaatcagatttgtgagcaggcgggattgtaatgggttaatttaacggggaagtgagtatatgtggcgttatcaaatggcagtcaaaggctcagagcaggaattgcgatggctcaatcagcaggtacaacgcgggcaattactgcggcgtatcagggggaactggtatcaatttcaaaaaacggcgacgcggtatcaagtctttagtgaatatgtgagcggcaatgttgcaactgaaatcgacgaccagcacacaccgttcaaattgttagcacggctacaattgacgaaaccagccgtacaggtgatttatacgggcacggctcagactgagttgcagggggcgcgagtggatcgtcaggacgcaccgttgcagttgaaaattgcactggcgcaacggggacacttgttaaatgtcatgaatattaggttagtggttggtctgatactggccgtgatcgtgattagcctgaatgtgagtgataacgtggccagttggggaatgctagcatggttgctatttaccttctatcctgcatggcaagcaagtcggctgcataaacaggcgaatgcgctgcgagtcattacgcaacaatatgatgatgcttggcggccaacgatgcacgttttcctgaaaaacatgtccaccgagctggatacagaaaaagtggctggtctaggggcgtgggcttacgtcggtcaagatcatcacgggatgtactggtacgacttgaagacgctggcaagtgctgcggaaatcaagcaatcgctacagccaattgtgggagatagcgtttctgtatcgattgtaagttggctgggattggcaccaattggatttgtttaaacttttaaaatggaagtggtaggtatgtggcggcatcgatttttgatcaaaggttctgaacaggagttggcatggctgaatgcgcaagcacagcgacgctatttattgatggctattcatggaaattggtatcagtttaaaaaagtgccgacgatttatcgggtctttagtgagtatgtgccgcaagcaatcgcggctgacatgagcaacagtaacagcgcgtttcaagttctcgcccaagtgcaagtacagcaaccagatgttcagattgtgtataccggcagcgaccaaccagcattacagcaaacgacaatggcaccaactgatcctgaggttcgtttgcaagtagctttgcagttacgtgatcaggcgatgaatacgatcaacctcagtctttatgcaggggttgtggtatggggattgtttttgatactgatccttcatcagggtgatacagatttaataggcgtctggatgctactgctgttagtaggacttctcgcggtattaggactgtatcggacggcacatcgtttgcagaatcaaatcagccagttacggcgtgacactgaacagtatgacggggcctggatgccgacgatgcacgtttttgtgagcgcattgactgctgatcttgacaccgaggaaccggcattaaagtcgttaggccggtggaccttagttggtcatagtaaaaagggccagtattggtatgatctgcaaacgctagccaatgcggcagaaatcaaacagactttacgaccgttcgttgcgactgacactaacgtcaacgttctgagctggttagggctcgcgccactgggctggtttgtgtgattggcaataattgtttgtacaattaacatataaaacgttagactattctgagactaacgttttttttgtgtttaccggtctgatgataatataaatgataaaaagtgacatataatcataatagtagtattctaaataaaagacaaagctggaataggttgagtgttagttaatcagctggaaattaatggatattgcgcgaattttactataaaagtttttttattcgtcacaaatatttcatataatcgggttaacttaaatagtacaagctcgattgtgttgaagacaattgagctgattacacagaaagcttagtgaggtgattttgatgcgacttaaggatttaactggtgagactttcagccgtttgaccgttatcgaacgggctgaaagtgcgccgaatggtaatgcacggtggttgtgtcagtgttcatgtggacgacaagtagttgtcgatagttatcggttacggaaagggattacgaagagctgtggctgtttacgggcagatgttagtcgaaagaatatttttgaaaatccgcaaacccgtaaaaatatgggacgtagtgataacttaccgctttatcaaggaacttcggtcgatcgattgaaaccgaatagccggaatcggagcggggtcattggtgtttcctttgaccgatgctcacagaagtgggtcgcacggttaatgtatcggggccgcttagttttgaatcagcagtttgctgatatggatgatgccatcatggcacgtaagcaagcagaacaacgctacgttatgccagtgttagaagaatatgcgaaatcaagcgcggattaagatgcgtacataattagcatgccaggagactggtgtgctttttttgcgattattacccgggaaataaacgagttagattaatacccgtgaggaccgattatttgtgtttattgatcaaactagttagacttaacgagcaatttaaattagaacggaggaactttgagcatggaaatgggattagcagggaaacgggtcttggtcactggttcgactaagggaatcggacgggcaattgcggtagcatttgccaaggaaggcgcggatgtggtcattaatggtcgccgcacagatacggtggcagcggttgtggatgaactcgcagcggcatacccaacaactcatccagtggcggcaccgtatgatattagtgatccgcagcaagctgacaaaatgtttcaacaaattccaacggttgacgtattggtcaacaatatgggaatctttgggccaatggcttacgatgagattgacgatgcaacttgggaacgcttctttaaagtgaacgtgttgtctggcaatcggttggcaaaacattatttacctgcaatgttagcccaagattttggacgcattatctttattgcgagtgaagaagcagttatgccttcgggggaaatgccccaatattcgatgactaaatcgatgaacctttctttagcgaagagtctgtcgaagttaacagttggtagccacgtaacggttaacacggttatgcctggctcgacattaacagaaggtgttcagaaaatgttagatgatatgtatgctgattcagatttaccaaaggatcagtgggagcatgactttatgattaatcatcgaccactatcacaaattcagcgtttgattcggccggaagaaattggtcggttagcagtgtttgtcgctagtccgtttgctagcagtttttctggtgaagcattgcgggcggatggtgggttagtccccactatcttctagtggctaatgaagacgatatatctttctggttctgccatcgaaattcagatgtcaaaaaactgttttagcgagtaaagtttatcgccaaaacagtttttttgttgacttgactagcctaagaagccagtttcaagcggattagatgtttaaaatgaaatttttaactgattgactggctagtcattgacttatcagtcaacggcgcctatgattgcagcatcaacaataagatgctcgaatttgaaggatgggagtgagtcatatggataaagaaccgttattaaggattagtcacttgcaaaagcatttcgggaagtttcaggctctcaaggatattaattttgaaatcaacgcgggggaagtttttggctttatcggtccgaatggtgctggtaaatcaactactattcgggtactacttggaattttaaaagctagtggtgggcaggcgacgatttttggtcgcgatgtctggcaggatagtgtggcgattcataagcgaattgcttatgtgccaggcgatgtttatttatggcctaatctaagtggtggggaaattattgacttgtttcttaaactaaacggtggtcagcatacggctaagacggacgcgctaattaaacaattcgaactggatccgcgtaaaaaagcgcgcacttattctaaaggtaatcggcaaaaggtggccttgattgcggcactctcaacggatgctgatctatatatttttgacgaaccaacgtccggactggatccgctaaatgagcagacgtttcaaaatgaagtattggctttaaaacggcgagagaagagcgtcctgttatctagccatattctgtcagaagtggaaaaaatgtgtgatcgcatcggtattatccgtgagggacagattgttgaaacggggtcgttagctgagatgcggcacttgacccgaaccacggtcgatgtgcaaacacgactgcctttgaccgacttgaccaccctagctggtgttcacggggtcacagcgcgccacggagataaccacgtcagtctggccgtcgatgctgaccaattgacgccggtagtgcagtacttggcgagtcggaaactgatcagcttaacaacgaccccaccaacgttagaagatttattcatgcgctattacacgaccgaacaacaaccggtgaaggggaagtgatgctgatggcaacacaactatttgctcgtaccggattactgatacggttcaacttacgacgagattggaaaaagttgctcatttgggtcgtcgtgttgacggggctattcacggccatcgccgcgaagtttgatggtatttatggcactcagatggcactgaatgaaattgtcaaaacgcttaaaacgcccgcgatgatttccttatttggtgcgttttcggccaaatcgccatatacgacggccaaggtgtttgcaactgaaatggtggtttttatggccatcgtcatgattgtgatgaatatcatggtggccgtggttacgacgcgcggggatgaagatgatggcctgctagagctagtgcgtgcccacgcggtcggtcggttagcaccactattcgccggggcagctgagttaacggcgctaaatggtttgattggttttctttttgccctcgggctgaccgtcgccaagcttccgggagcgacgacgccaggtaattggttaattggtctgggcttagggggcttaggctgggcttttggaatgttgacgctgttacttgcacaggtaatgactagtgcgagtggtacgacgatgctgagctatttgctactgggcgtcatgtacgttgcacgaatgggcacggatgttaaccgtccagacctgacttggtggatcccctttggttggattgaaaaattagatgcgtatcaaaccaatgattggttaccaatcggtctgtatgtattactgggtcttggttgtttaagtttggctgcagctcttaatgcttatcgggacttgggcgcgggcttagtcgaaccacggcgcggtcggcgacaggctagcggtttattgcggggtcccgtgaccctattatggcggcaggcacatggtctgattattgcatggctactagggaactttatcttaggtgccgcgtatgcgtccgtctttaatacgattggcgatctggcaaagagcaatccaatgatcaaacaactgctaggtgcgtcagctttagcagcagcgaatcgcttgatcgtcaaaaatttcattgctgtgttggctatcgtcatggtgatcgttgcactggttccagcagtacagttaatgctcaaactggtcaatgatgaacaaaaaggctatctacatcaagtttatgcgacggccacatcacggtggcacgtgtgggcaagctataccggctgggcaatcgtaacgggactgctcgttttacttgccggtctaagtggtatgtatttgatgggcctgacgagtatggtcaagcccatcagttgggtgacctattggcacgtgtttgcggcctatgcaccggcgatgttagtgatggtagcggtgacgagtgccttagcgggctggcgacctaaatggcggtatgctgcgtggatctgggtattttacgccttcttctcattgtatcttggtaatttgattgatttgccaaaatgggcacgccgtttaacgccccttggctttgttaacaaggtaccaatcaagcccttagatggaacgacaagtagctggtgcctattattaactgtgctaatattagtagtagcagcactaagttatcggcggcgtgatctagctcagtaaacgaaaggagtgcgtgacatggcagtaaaacaacctgttcctaaagacccggcgaaggtcgagcgtattatgcacgcggccatgcacacctttgccgtcagtggctatcgagatgctaaaacggatgtgattgcgtccgcggcaacggtgtctaagggcctattatttcattattacggtagcaaacagcgcttgtatttggccactgttcagcttgctactgacacgattattgccaccattaatcaacaagtttttgatgttccagatgacctagtcacgttgatggtgcggagtgcgcgttacaaggcggcgtttggtaaagaccacccggatgaaatgaaggtcttgattgacgcctatggcgcgctggagcgcttgccggtaaagatacaggcacaaatgaagatcctgtatactaagtcgatgactatttcccgggaaatgatcagtcaggtgctggataaaatgacgctgcgtgcggatgttgatcgtgatgcaacgattgctttgattatgggtgtttacaatcagatttttatggaatttcagacctatatgcgtgagaatcatcaagttgaatcgatggccgatatcgaatgggtggtcagtcgcgcaaaaacctacatggggattttagaacatgggtttatggcggcggatttagatgaccagcagtaataatacgtatcttagacagccgacggatgtttaatccggacgactgtttttcgaccggtggattcggcagcgtttaatagtgataatgtttattcgcttttttcgttagcaggctaaaaatgtggtaagttagacttaatagatgacggatgaagtgagggatcggaatggaattacatttaacggcacgacagacgggattgtggcaacggttgatggcactggcacgtgagcaattgatgggactcgccatgcagatggagtcgactgggaaagtcgatcgaccgacactgacaacgcttgcccagcaattggctttggacgatccactaccagatgaccgcctgagccaacgggttttgagtacattagcgctggcgcaaagttcagctgggctcgctatgagttttgccagtagttggcaagttgaggatgcaatattaacgtttggaaccccgcaacaacgccaacggtattgtgcacaatcaggtgtttttggactcgcggcattaccggaacaagtcatggctagtagtaccgtcaaagcaacgccggtaacagctggctggcaactgtccggtgcggttaaaacggtattgaatgttacacaggcaactgagtatttagttctcgcacagacaccaccgaatgctacaggggcctttgttattagtgctgatcagccaggcgtcacggtcagccaaccaataacccctttagggttacacggattgaccatcgcggatgttcaactcaccgatgtcccggttacggccgctgatcaaatcggtcaattgggacaaggacaacgagtgatgcaacgggcgcaaagcttggggcaattatttgccggggcgattacagcgggaatatggcaacatgccacagaccaggcacgacagttagcgctgacagaacagccgccgttaactgccttggcgccagcaatggcgattacggccgccttacagactagtgtctacaatgcggcccaacaggccgatgatgagcgcccatttacagacgcagcgcaattggcggcaatgtttgccagccaaaatgccttggcgccgtttaaaattttgatgccattgatcggtgatctagcctatacgcaacactcgccgttaagtgccttgcaaaatgacgtggcgacactaccgttgattgttggcacggatacgcaattggcgttgacttttgccacgacgagcctgaatgacgaagtggccgatgtcccgacaacgggaccccacacagctcctgagcacctagtcgtggccgacctacatcgggtcgtaaaacgcttgaatttgactagggatgtgccagtcaatgtcggcagtattgctacggcgaaacgcgtcgtggcattaggtcgaggcgcgatggaaccggcagtattgcttcaagcccaacaattggccaagtggattggtgcagcattggctgttacccagccgctaacggctatggaacaatttagcattgagcaacaaattggtgcctcagcagtgacggttgcaccagaagtcttgatcaacattggcgtcgctggtgatgatgattacttggctggcatggctggtgcgcaacacgttctttctgtgaatacggatgaacaagcgccaatcttcaagcattcacaacaaattttcgtgggcggtgccgctgaatttttggccggaatggtggcagcattaaattaatacgaagtcgagttcggcactgttggtaggtctgacggggtcgtatgacaatcaattgtttgcacaaaaactaagggtcacagcaatgtactgtggcccttggttttttacttagctttaaattaagtaccaccagtcattacttaattaacgaaataattaatgaccaccgtcacttaaaacgtgcggtgagctggttcagaatcggaatcttaaatagggcaatcaagataactgagtagcagacgtaggttatgacttcttgtatcatgcgcgttgttagcaaaactgaccatggtgttaagtacatgagatgaagccagaggctgtttaaaaacaaattgagaataaagacgacgataaagttagcgacgagaacgcgcgtcagtgaagtttgatgttgaaaggcgtatccaaagactaacccagtcagaaaagcggttaggataaaaccaggaaaaaaggtgaactttgggaagagcagcattccgagtagggaggaaatcgcgctactgccggctgtaactagtggtgaaaataaacgggccgttaaaccaataataataaacgcgaaggatatcttggttagcaatagttgaattgacagtaaactccctaagataagttgcatggcaattaaagcaccgagtaacgggatacgccgaaccgtgagtgatgatgtcataataattgaagccccctaagtgtgttgaatgtattttaggggaatttgttgagaattactagacctgaaattattggttataagtaatataaaaatatcgctaggagaaacgctatgacgttatgtagcgtttctcctagcgatcaattaatccggaatatggctcccgttggacatgggttgcagttatcgctacaatgttgataaaaggcagtatggaggcgtttgaatggcatacattacaaaaaagaaaattgcacaagcctttcatgacgtcgtcctagtgaggggctttagccgaacttccgtgacggcaattatgagcaccgccgattttagacggcaaacattttatgattattttcaagataaatatgaattattaacctggtttattgatgacaccctgactgaaacggttgaacataatctgaattatttgccttggatcgacattattaaactagtttgttacgagttagatgcgaatcgtcaattttatgcagaatgtattaacacgcagcatgaaattgacgtgacggcacttgtcggtaaccacttagccacgttattgactgaactaacgcacgccaatacaacagaaacggcggccctaatctggttgctgtgcttgggaatcgcacaatcgttaacgcataatatcgttgcgaatcatcctgaagattatgaggtgctttctcagcacgctattgcggccatcgaaatgacactcgaaattttgaactagttaggccaagcagcagttttgacgggtcggtttagagcagttaaccagtcagggtcggctaggctgagtaaggttaatgacaacccatgcatcccgttagcagttaaaaaagttcccactttgttgaagtcgattgttagtgcggctaaggtgagtaattcgtgaacatcattattgaacaccatgagttccatgggcgttgtcccaccgagggagttaacgaaaacggcgtaatggtcgtcagcatgccacttaaagttgagacgtaatttactaattaattcctgtgcgagtcgttctgacgattgaaaaggttcacgccgataaccgggttccccgtgaataccgataccgtaataaatttcaccaggattcaagttaaacgatgccgttgactgtcctggaatgcgggcgccgctagcagcaaccccaatcgtgtgaatgtttggcactagggcggcagcgatgtgggtcaattcagcgatagaggccccctgagctgcagcggcaccaagaattttatgcactaaaatcgtgccagcaactcctcgtcggcgctgttttaaagattcatgatccacggaaatatcgtctgccacaatacatagaccagtttgccaatgttccttttgcagttgttgttgagcagccgtaaacgcactaacatctgctggaaaatttttaacaatgaaaaaaacgcgacgctggcgtgtcacctgttttgtgactttaacgatttcttgagatgtagggggttgaaaaaccgttcccatgattgcggcagttaacataccaggcccaacataaccccagtgtgccggatcgtgaccgctgcccccaccagcaattaacggaatctgatcatcttgaaagttgctgtcgtaacatccgaatgtatttggtacccatgttaaatttggataggcccattgaatgccctgagttgcttgactcagggcattttgaggttcattaatgatttgcatgggaacaccttcttatattgttagtttgattttattataacgcattcgaatgaccatgcttgtcggaagctggcggacaaaataacaaaactgtccattatttttgaaagcggattcatttacaattaacttgttaattcgagaaaggaaggacaacaaaaatgaaaaaaataattaatgatcccaagaatgtcgtcgacgaaatggttgatgggttagtacgtgcctatcctaaatatttaactaaattaccggataccgaagcaatggttcgtagtgatcaagattcaatgcggggaaaagttggaattgttagtggtggcgggagtggtcatgagcccgcccacgccggctttgttggtcctggcatgctcagcgctgccgtggcaggacaggttttcacctcaccgacgccagaccaaatttatgcggcaattaaggctgtcgatcaaggtaagggcgttttcttagtcgtgaagaattattctggtgatgtcatgaatttcgatatggcgaaagatatggctgaattagatgatattcaagttaaatcgattgtcgttgatgatgacattgctgttaaggatagtttatatactcagggtcgtcgcggggttgccggcactatctttatgcataagatacttggggcggccgcggatcaaggcgctgatttggatgatttagaaagtttagcaacgcatgttttaccacggattaaaacgattgcggtcgcattatccgcagcgacggtgccggaagtcggcaaacctggctttgaattggcagatgatgaaatcgagtttggcgtcggaatccatagcgaaccaggttatcggcgcgaaaaaatcaagccatccaaacaacttgttcaggaattgctaggtaaattagatgatgaattacacctacagtcagatcatcagtatgcgttcttggttaatggtatgggagcgacgccattgatggatcagtatgtcttttgccatgacttgttggatgaactggcaacacggcacattcaaccggcctttatgaaggttggtaattatatgacttcgattgatatggccggtatttcactgacgatattcgatgttgctgaatctcaatggctagattacttacagtacccggtcaaaacaatcgcgtggtcataaggaggaattgagaatgttaacaattgagaacacaacagtatggctgaataagtttgctgaccagattgaacaacaccaaagttacctaagtgaattagatacgccgattggcgatggtgaccatgggggtaatatggctcggggcctagcagcagttaaggtagcacttgccacgcaaccagcagacataactaaactatttcaagcaacggcgatggcattgattagcaaagtcggtggtgcttctggaccattgtacggaacagcttttttagaaatggcaaagcaaagtaagattgatagcgatttaggtggattgttggccgctgcattagctgggattgaaaagcggggtggcgcgacaaccggcgataagacgctgattgatgtgtgggcaccggttgttcaggcggtccaagcgggcgaattgacgcaggatgttatcgatgatgcagttgctagcaccgaaccgatggtggctaaaaaagggcgagcatcctatctaggtgaacgttcagtgggacaccttgatccaggtgctgtctcgagtggttatttatttacaacgttactggatacggagggaatcttatgagtttaggaattgtagttgtttcacacgtcccagaaattgccgcaggtattcagcgtttgttagggcaagttgcccaggacgtttcgattacgattgctggtggtacggatgacaatcaagtcggaaccagcctgaccaaaattacacaagcgtttgatgcaaatcatgcggatgaactcttggccttttatgatcttggtagtgccaaaatgaatctggaaatggccattgaaatgagtgataaaacggtccatttatatgatacggcactcattgagagtgcctacacggccgcatcgctattacaggcggctgtgccacttgcggatgtcgaagctcaattagcgccattaaaaatcaagtaggatggtgacgaaacatgcacggttttttaggtgaatttttaggtaccatggtgttaattgtatttggggttggtagtggtgccgccatgaatttaaagggtaattatgcacgccatcagaattggacgtttatttgcttggcgtggggcctagccgttacgtttggggtctatgttgccggacaatttggttcggatggtcatctaaatccagcggtgacagttggttttgcgttattcggttatttgccaatggctaacgtttggccgtacttattaggccagttcttaggggcctttatcggcgcggtaatcgttattattcagtactacccacactttcaagctgccaaaacggcggcagatggcaatcaagttggcatttttgcaactggtccagccatcagtaacccggtatttaattttctaagcgaaacgattgcgaccttcttctttatcttcgtgttgttgaatctcggtaactttacccagggattaaagccattgatggtggggctgctcattgttgtcgttggtcagaccttgggtggaaccacaggctttgcgattaatccggcgcgtgattgggcaccacgattagcctacacgattctcccggttcctaataaagggttggctaattggggttatgcctgggttccgatgtttggtccattgcttggtggtattttggcagctggtctggaaacaattattagttaaatactcacaactgtgccgattttgttgggcacagttttttgttataaagtataattaaataaataatgcaagtttatgcaatcgcttgcaataacgatgaaaacgttttatatttaatgagatggattcaaatagatcggggggatcatgatggcaacgatcaaagatgttgcccagcgcgcaggtgtttcgccttcaacagcgtcacgtgcaatgcatggtagcaagattatcagtaagccaacacgtgacaaggtcattaaagcggcgcgggagttaaattacgcgccggattttaatgcgcagaatttagcaactaaggctagtaatacaatcggggtggtactaccagtagatcatcacgaaatcttttctaacccatttttcttagagatgattcggggtatcaatgaagtttgtagtaagaatggcgcaatgacaacgctagcaacggggatttcaagtgatgaactggtgcataatattgatgtcatgattgcacaaggccatatcaaaacttttattttactgtattctgaaaaaaatgacccagttgttgagcgcttgaagcaatttgatgtccaatacgttgtgattggtaaaccttaccaagacgtcaataaaacatcgtatgttgataatgataatatccaagccggaacggatgcagcccaatatctaattgatcatggacaccggcgcattgggtttttgtattcggatttatcacggatggtgcaaagtgatcggatgcttggctatcaacgtgtaatgatgcaaaatcagttaccaaatattatgttggaagaacggtttgagactcatgcggcgggtgttaaaacactacataagttttttgaacagtatccagatgttaccgggtttgtggccgtagatgatatgttggcgttgaaattacaacaggttctccataatgatccgaactggaaagttaaacaattctcactgattggttttaataactccattttttctgatttagcgcacccgatgctgacatcgattgcggtctttccacagcgtttaggtgaagaagcggccaagattgcgatggctgaccatcctgctgatgaattatcaacggcagtaattgtgcctcatcaaattgttaaacgccattccgtccaccaaatcaagtccttacagtagtaagttaggggggtattttgattatgataacgctaaacgatgtcgcgaaaaaagctaatgtctcaaaaatgacagtttcacgagtcattaatcatccggaacaggttcgtcctgagcttcgagagatgattttaaatgtgatgacacagctagactatcatccgaatgcggcagcgcgagcgctagtagggcggagaacccgggttgtaaaattaacgatttttgaagacatggacacgacggaaccctattacatgatgttgctcgcggggattgcgaatgaattgaatcaacatcaatacgccttgcagattgcgacgcgcaatagctatgaggttggcgaatgtgatggctatattttgactggtattcggcaagccgattacgcatgggtcgaacgtcttaatcagccagtcgtctttgttggtagcaatcgtcagggatacgactacgttgatactaataattatcaggcggtctgggaaagtacacgttatgccgcggaacagggctatacgcatcttgtctttattggtatcgctattgccgaaccgtttgagctagatcgtgaacgaggttttcgagagtacgtcacgacacatcatattagcgctcagattattcgattagccaatcattcacacgttgcaactgcgtatgtgaagagccattggtctggttttccacgtaatacggcgtttatttgtgcaagtgatcggttggcgatcggcgttgaaacggcaattattaatcaaggtggtcgcgttcccatagaatatggcattatcggttttgatggcgtgttattaaatcagattgcagccaaacggttgacaacgatgaagcaaccgcttgaagcaatgggacgagctgctgcacggctattattggctaatatcaaccatactgatcgttctcgcgggcggcatgatcaagaaaaaatcatcattaattcacggttgtcggtggctgaatcgacccgttaaagaggagtctggataaatgagcaagcattggtatgaccaacaaacgatttatcaaatatatcctaagagttttaacgatagtaatcacgatggcattggtgatattccgggaattaccgcgaagattccctatttgaagcaacttgggattaccacgatatggttaaacccaatttatcaatcaccccaggttgataatggctacgatgtttcggattactaccaagttgattcgagcttagggaccatgacggacgttgagacgctcattaaaacggtccatgagcacggcatgtatcttatctttgactttgtcttgaatcatacttcagatcagcatccatggttcaagcaagctctcgctgatccacagagtaagtatcgggactactatttatggcaagatcccgcagccgatggtgggcgcccaaacaactggggctcatttttcggtggcagtgtttgggcgaaggatccggcaggcggctcacagtattatttccacttgtttgataaacggatgccggacctcaattggaagaatccggcagtgcaacaggcgatgcgtgatgttgctgagttttgggttgaaaaggggattgatggtctccggttagatgcgtttattcatctggctaaagcagattttcgccaaacttatccaaatcggactggtgattcgacacccatcattagcgatatgttttatgcccacttaccgaaagtgcatcagtacttacacgactttgtcgccgcaatcaaagctaagcacccggatacgtacgtcgtcggtgaagcgtcatccgctgacccccatttgatggtcgactatacgacaccaggtacggatgagtgtgatcaagtgattacgttcagaacttttgcggacgacaatacccaggatgatccgagcttctccgacacatttcagccccgaccgatggatgtgacggcctataagcaaaatacggtcggtattcaagcggctttagcagacaccagtctaccaacactttactggaataatcatgatatggctcgggtcgccacgcgttacggtgatcctgattatccgcaagcaagtgccaaggcgttagcgacggccctgtatttgcagcgtggcattcccattatttattatggggaagaattaggattaacaaatatccgttatcatgatattgcggactttgaagaccagacggtacccacctttgttgcgagcgctcaagccgctggtaagtctgaggtggaaatcatgcggatgttgaatcaaactcataaaatggcggggcgcggccccatgcaatgggacaatacgttttatcatggtttctctgaccacttaccatggaaacatggtgatactgatgacatgaatgcgcaagcagaaatcgctgaccccgacagtatttatcactattatcaacagttgctgcagctaaagcagtgcgcaccctttactaatggtcagttcattatgctcggaagtgctgaacaactctttacctacctcattgatgatggtcaaaaacaagcagcgatagtttgtaatttaagtgcgcaagcgcaaacgtatctgttgccgtttgttggtggtaaagtgttgcttgtacagggtggtgcaacatataggggacgccaagtgacgttaccagcttggagtagcttagtcgttaaatcggcataagcaatgtgagtgcatgattatcctaaaattggtatatataaatcatgtgatgtattttaattaacttatcaatctttatataaattggtataaaggttgatggaccaataaatcctaacgtttttaagcgttaggatttatttttggtatgattctgttaacgttaacattacgaaaacgcttgcgaaagcgtttgcacagttgcataataaattatggtaaatgaattaagatacttcgcaaggaggaagcactatgagtacttggaaaaagttggggatgggtgccctagccactggtttagcactcacgctcgtaggttgtggtaatagtaaatcttcatctagtagttcaaagatggacaagacgttaaaggtttcagcggatccttcatataagtcatacatgaaatcggtgattccaaagtttgaaaagaagtacaacgttaaggttaaggtttcatacaaggccatgcttgatgaagacgatgctttgaagctggatggtccttccggcaagggtcctgatgttttaatggcaccatacgaccgggttggtcaaatggcgtcacaaggtcaactatcaacagtcaagttgaccagtggtcgttacaacgcaacggggaagaaatctgttacttataagaataaggtttatgcagcgcctgtaacgatcgaatctgacgttctgtactacaacaagaagctaatcaagactgcacctaagaacttcaaggaacttgaaaagttagcttctgacaagaagtatgcttacgctaatgataagactaagtcagttgccttcttgactcaatggacaaacttctacaatgcctttggtgtcatcaaaggttatggtggttacgtctttgctgatggtaatacgaacgccaagaagatgggcttgaacaattctggcgccgttgaaggtttaacttacatgacgaagtggtttacgaagtactggccaagtgggatgcaaaatgtcacttctaacgaaaactttgtgacctcacaatttacgtctaataagactgctgctgttattgatggcccttggatggctgcaacttacaagaagtctaatatcgattatggtgttgctgttttacctaagttgaataacggcaaagattatcaagcgtttgccggtggtaaagcttgggcaatctcaaactactctaagcataagactgctgcacaagcttggttagacttcatctctaacaagactaaccaaaacaagctttacaagtctgctagtgaaattccagcaaacacagctgctcgtaaggaagctgtaagtactggcgatgacatggctacggccgtttcaaagcaatacgacaaggatgttcctttgatcaacttaccacaaatgtcagaagtttggacaccagcacaaacgatggttaccaatgctgctagcggcaagatgacaccaaagcaagctgctaataaagcgcaaaagacgatcttaactaatatctcacaaaagtatgataagtaattaaaattgtaatttaagggggctgaaacaaaattcgttttgtctcagcctttttaaaaggaaaaatgcacgatatttagaatttatttaggaaaggggtgcgggcgacatgcaagtcaaggatgtaaagaaagcgcaacgcctgtcaattattcccgggctcggtcagctgtataacggtcagaccataaaaggtgttggcttcattattattctattggcatttattgctgagttcatcttcgggggctttagcgcatttgccaatttagtcacattgggttcagtctcaatggaagacaactctttgttcatgatgatctatgggacgttgcagattctattgacaattgtgtttatcgtattttatattgcaaacctttacgatgcgaaacacgttgcacagttaattaataatggtaaaaaggtctcccatacgtttaaagagttaggtgcgagtttagtagatggtggctttgcttatttattaaccacaccggcctatattttaatggtttttacgattgtgttcccagtattggttacactactgatggcttttacgaactatgattttgcgcatattccaccagctatgttattggattggattgggttcaaaaacttcacatcaatgttcttcttgagtagttaccgggcaaccttcaacgctgtttttggttggaccgttatttggaccgtatgtgcaaccacgttacaaattattattgggattgccaccgcagtaattgctaaccaaaacttcatcaaaggtaagcgcttcttcggagtgatcttcttgcttccttgggcgattccagcgtttgtatcaattatgagtttttcaaacatttttaatgattcagctggtgcgatcaatgtgcaggtcatcggcttatggaatacgttagttccatttgctcacattgcgccgatccactggatgacggatacgttctggactaaagttgctattattatgattcaaggttggttaggattcccgtacatttacgttatgattactggtatcctgcaagcgattccagaagatctctacgaagccgcaacgctagatggtgcgacagtaatgcaaaagttcaacaagattacgttgccaacgatttttgctattgcagcgccaatctttgtgacgcagtatacgtttaacttcaataacttctcgatgatctatctgtttaaccaaggtggccctggtgatgtcggtgctaacgccggtgggacggatatcctgatctcatggatctacaagttaacaacggggacgtcaccacagtattcattggccgcggccgttacgttgattatttccgtcttagttatcgggatctcattgattgtcttcaagaagacccacgcgtttgaaatgggggactagtgttatggataatgcacaagcagtggcacctaagaatgccaattcaaagcaaaatagcgcgcgtcggcaccgtttctggaaagaattctttacgtatctgtatatggtcattctcggaattattattatttatcccgttttgatcacattcatcacggcgtttaaggatgctaacgtgcaagccttcgtccttgattttggtggtaagtggacgttggttaactttaagaacttatttacgcaaaccctgtatggtagctggtatttgaataccatgattatttcagtctcatgtatggtcattcaagtcatcgttgtgacgttagccggctatgtttatagtcgttaccgttttgctggtaaaaagttcagtctaacgtttttcatcgtaattcaaatggtaccaaccatggccgctttgactgcttactacgtcttagctaacatgttgaacgctttggaccattactggttcttgaccgcaatttacattggtggtgggatcccacagaacacttggctgatgaaaggttactttgacaatgttccgtatgatttggatgaatcagctaagttggatggtgctggtaatttcaagattttctggtcaattgtcttaccattagttaaaccaatgattgcggttcaagcgttatgggccttcatgtcaccagttcaagattacctgatggcgaagttcttattgacgtctgaatcacattatacggttgccgtagggctccagacattcattaataacgctcaaaatcaacaagttgtgctcttctcagcgggggcaatcttagtcgcgttaccaattgctgccttgttcttctacttacaacggttcttcgtttcaggattgctcgctggtggcagcaagggttaactcaaatattagtaggggtgaaattagatgcagagtacgaaaaacaaaacaaccgcctttccggtccggttttttggcagcctctcctcacctcgaagaatgtttgccaaccgtgatcagtttaattggttacagattattgttttatttatctttttgaccgcggtaatggtcatgccgattccgttttactataatcaccaaacgaattttaatctgtcaccatttttaccacacattgataaaatgatggccagtgatcagatgcaaacggcaatgaaaactgcgaactaccgtgatcagcggttcaaggatgtcaaacatcaaatcattattaaaactaaggataatgttgctggcttcgatctcacgaacgatgatatggcaggacgcaagaatgtcattaatttacatgctagtacgtttcaagtgaaatcggtcggtagtgaatttaaagccaagtatgtgccaggccataacttaaagacaaacgctcatgcgtttctggttaattcttggtatcaaagcaataaagtgatgattggtctatttatgctcatggcacttggattaattattgtgggggtcaacctgatcctcgtaaatggggcggcgttcttcttattcttgtcacgacataataagatcacgcatattcggaatttccgcgaaggtgttaacttaacgttgatgatgatggggattgggagtctgttagcgatggtgattggcttaattcattttgatgtcaccatcgaattgaccgtgcagtccctcagcttggccttcgttgtgttgtgggtatatctgaaaacaaaattcaaagatccggaagttgaccaaaccatgttgctttaggtcaattagtaagcatagaaatgaggaagattaatggcacgcgatacgcaaacgcaattacgcaatgagatgatttactcagtctttgttagaaactactcagaagctggtaattttgctggcgtaactgctgacttacaacgaattaaggatttaggaaccgatattttgtggctactgccaatcaatccgatcggtgaggtcaaccgtaaggggacacttggttcgccatatgcaatcaaggactaccgtgggatcaatccggaatacgggactttagctgactttaaagcactcacggatagggcgcatgaattaggaatgaaagtgatgttagacattgtctataatcacacttcgcctgattcagtcttagcaaccgaacatccagagtggttttatcacgacgcggatggtcagttgacgaataaggtcggcgactggagtgacgttaaagacttagactatggtcaccatgagttgtggcagtatcaaatcgacacactcttgtattggagccagtttgtggacggttaccgttgtgatgttgcgccattagtgccacttgatttctggcttgaagcgcggaaacaggttaatgcgaagtacccggaaacgttatggttagcggagtcagccggcagtggttttattgaggaactgcggtcacaaggctacacgggtctgtctgacagtgaactttatcaagcttttgatgtgacatacgattacgacgtcttcggtgattttaaagattactggcaaggacgcagtacggtcgaacggtatgttgacttgttacaacgccaagatgccactttccctggtaattatgtcaagatgcgcttcttggaaaatcatgataatgcacgcatgatgagcttgatgcacagcaaagctgaagccgttaataacttgacctggatcttcatgcaacgtggtattccgttaatctataacgggcaagaatttttggccgaacaccaaccatcattgttcgatcgggacaccatggttgcagatcgtcatggggacgtgacatcactgattcaaaagctagtgactattaagcaactaccattactgcgtgctgcggactaccaattggcagtcgtagaagaaggtatcgttaagattacttaccgtgcggctggcgaagcgttaacagcctggattccgttaaaaggtcaggtcacagcagttgcgactaagctagcagctggtagctatcaaaatctgttaacagatggtcctactgaagttgtggatggcaagctgacagttgatggtcaaccagtattaattaaatatgccactaatacggcggtaactaaagttgctgaccagtccaattagctgattaatagctttgagtaatcgatcaaaaagcaaccgtttgcgggcgattgcacgtgtaatagtagtttagaagtgagaaaacaagggagtggatttcgatggttgaaatgaatctcgatcacatttacaaaaaatatgagggtaacgataaatattcagttaccgatatgaatcttgatattaaagatggggagttcatcttcttcattggcccatctggctgtggtaagtcaacgacattacggatgattgctggcttggaagacatcactaagggtgacttcaagatgaacggtcaagtcatgaatgacgtggaaccaaaaaatcgtgatatcgcgatggttttccaaacttatgcactatacccgaacatgtcagtctttgacaatatggcctttggattgaagattcggaaaacttacagtaatactgaaatcaaaaagcgagtggataacgctgctgagcaattgggcttaaccgattatctacaacggaaaccagccaatttatctggtggtcaacggcaacgggttgctttaggacgggccatcgtccgggacgcggggacgttcctattggacgaaccgttatctaacttagatgctaagctacgggtcgatatgcggactacgattgctcaaatgcatcaacgcttgaagaccaacatgatctatgtcacccatgatcaaattgaagcgatgacgatggctgatcggatcgtcattatgaatgacggtaagatcatgcaagttgggacaccgcacgaattgtataacgaaccggttaatcaatttgtggctggcttcatgggatcaccttcaatgaacttcttcaatgccaccttacatgatggtcgggtaactgatggtgagggactcgacgtagctgtcccggaaggtcaattgaaagttttaaaggctcaaggctatgaccagaaaaagatgattgtgggtatccgaccagaggacattcatgctgagcaaattgcgcttgaagcgatgtcagattcaattgttaagacgaaggtcgtcgtttctgaattcttaggtgccgaaagcatgttatattgtacagctggcaaatctaaatttactgcccaagtggatgcacgtgattatcataacccgggtgagaatgtggaagttgcttttgaaatgtcgaaggcccacttctttgattccgaaactaaagatgttattcggtaatttcgaacgacggaggagcaacaacaatgaaacgtatttttgaagtagatccgtggcacgtcattagtcatgaactcgtaccgacggataagcgattgcaggaaagcatgaccagtattggtaacggctacatgggtatgcggggaatgtttgaagagcactattctaacgataccctcaaagggatttatatcggtggggtctggtatcccgataaaacccgggtcggctggtggaagaacggttatcccgattatttcggtaaggtgatcaattcggtcaatttcatcaaagtcaatatcacgattgatggtgatcaagttgatttggcgaaggacacagtcagtgactttacgttggatcttgatatgcatacgggaattttacggcgttcatttattattaccaagggtgaaaagcgcgtccaattcatgattgatcggttcgtcagcgttgcacaaaaagagttatttgatgtgcactatagtgttcacaatttgggtgcggaaccggtccaaattggatttatttcgcaaattgatgcggacgtcttcaatgaagatgcgaactatgatgagcagttctggcaagtgctagacaagagtcatgcgattactggtggcagcatgtttgcagaaacgaagccgaataacttcggaacaccgcgctttacgctcggcatgcagatgcttcatgaaacggcttttcgaggtattaacgccccagaaaccgaaaaggcagttacaaatatcttccggggaacgttagcaccggatgaaaccaagaattttgaaaaacgagtcctcgtggtgacttcacgggattacgcggacatggcggcgatgcggactggcttagccgaattaagtgaaacggtcagcacacagtcatatgaggacttacggcaggcccatgttgatggttgggctaaacgctggcagttatctgacgtgttgattgacggtgacgatgcggcacaacaaggcattcgcttcaacttattccagttattctcgacctactatggcgaagataagcgcctgaacctggggccaaaaggctttactggtgaaaagtatggtggtgcgacgtattgggataccgaagcgttcggagtaccgttctacctttcattggcgaaaccagaagtaacggagaacttactggaataccggtataatcagcttgctggagctttccataatgctaaaatgcagggcttggctggtgccttgtacccgatggtgaccttcaacggaattgagtgccataacgaatgggagattacgttcgaagagattcatcgaaatgggtctattgcgtatgccatcttcaattacacacgttataccggtgatgagacctacttgaagactaaaggaatcgacgttttgacggggatttcacgtttttgggctgatcgggtccacttctcagaacggaaacaacagtatatgattcacggtgtcactggtcctaatgagtatgaaaacaacgtgaataacaattggtatacgaactttatggcgcgctggacgttagaatacacgttagcgagtttgaagaaagtggatgccgctaagcgtgcagcacttcaaatcacggatgctgagcttgcaaagtggcaagatattgttgaccggatgtacttcccgtatgatgaaaaattgggaatcttcgttcaacaagatggcttccttgataaggacgtcaagccagtttcaagtattcctgctgatcaacggccaatcaatcaacactggtcatgggatcatattctacggtcaccgtatatcaagcaggcggatgtcttgcaaggaatctattacttcatggataaattcacggcggaacagaagaaacgtaactttgatttctatgaaccgttgaccgtccatgaatccagtctttcaccagccgtccatgccattctagcagcggacttgcattatgaggataaggccgtggaaatgtatgaacggacagcccgtcttgatcttgataattataataatgatacggtcgacggcttgcatattacgtcgatgaccggttcatggctcgcaatcgttcaaggctttgctggtatgcgagttaaggatgataccttagcctttgcaccgtttgtgcctaaagcgtggacccattatcaattccacgttaacttccgcggtcgcttgattaaagtggatgtcgatcaacagggtacgaccgttgaactggttagtggggaaccactgactatcgaacttaatgggcaagctatcgaggtcgctagcaccgtaacaactaagtaaatatgaacgcttgattgtggtctgaccgtaactggccacaatcaagtttccaacctaagaatgagctcaattcattccaacctaacttctaaatcgaggctgtgacataagtctctagaaacaaagcaggtctggaaaaatcttcggtttcgtattctaatcccaattgaaatccagccatttgtttcagaataatatcttgattgagcccaatataccgttttgtaattgcttcactagaatgattgaaaatcatcatcaaagttccaatgtcgtgggtttgctgataataatggtagccaaaagttttacggagcgtatgggtaccaatatccgtccggtgcattttacgggcgatggtctggaacagcttataaacggcattaacacttagtggctgatgttgtcgattggtaaaaaggtattcattatctggtaaatctttaatatagtgattgatttgtggacgtaggcgtgtgagtaaaatcacacgcctttttttggtctttttttcagtaatgtggacaatatcgtgatagcgaatctgtccgacctttaagttaagaatatcactcattcgaagtccagtatttaaaccaattagaattaacaacgcgttacgctcaccgtgcgtaccgttccgagccttattaacgaagtcagtgatttcttcattggaacgtaagggctcaacattgtagtaaatattaatcacactctttcgtgggacgtactaattatgactattaagcattaattataaaccatattaattaataaatataatcaaatatctagtacaatacccgattacacgaataaacggcactattttaaaaaaaataatgccgtttcaacacaatctgtaatcaaatataacatcacataaatatttgtcaatgtaatatgtcattttattgtatgaaaatagttgttttcagtgcagcatatacaagtttatacaaattttatggaaataggtttgaatcattgatacaaaaggaatctttctttttattttaatgacgttacataaaatgtggttttaatttagttaattttggagagtgaatgatggatcaagcagtaagttttgacttttttatccggcttgtccgtaagtactggcgtgcaattgtcagttttacggtggtgggattgatagttgccgcagggttgaccttctttgtaattacgcctaagtaccaatcaagtgttcagattttggttaaccgtaagaatactaatgccgctactgagtacgctgggcaacaggctgatgttcagatgattacgacctacaaggaattgattgctgggcaggtggttttaaagccagctaagcagcaattaagtaaacgttatggtattgagcgctcactgaacacattgaaaagtgaagtgagtgtgacaagcacgaccaactcacaggttttctcaattgccgtgactgatgctaatgcgaaagctagtgcgacgattgccaatcaaattgctcgtagttttaagaaccaagtgcaaaagattattaaggttaacaacgttacgattgttgctccggccgaaacgccgagtggcgcagtatcgccgaagaagccgctgaatatgttgattgggctagttgtcggcttgctattaggatttgtttatgcagcgattcggatgctcacggatcgccgcgttcacgacgctgatttcttaactgatgaattaggattgactagtttaggcttggttaaccatcaacatcaccattcaatgaagaaacaggccttgaatctgaacggtggctatcatacgcataacgatcgaacatcgtcacaagcgatgaaacgagtttaggagggtgctagatgtttaaacgtaaagaaaagaatataacgactacggcaccaattaatctcaccacgattaatgaacccatgtcggtcattactgagcagattaaaacaattcgaaccaatatcaattttgcggctactggccataagttacgaactttaatggtaacttccgcaatgctaggagaaggtaaatcaacggtgagcgggaatttagctgttgaatatgctaaagaagggatgcaagtcctattagtggatgccgatttacgccggccaacaatccataagacatttggccttaaaaaccataagggattaagttcatggttagccaaccaaatggatgatgttaatgatgcaattcatcccgtcattggcaatctatttgtgatgacgagtggtcctaagccacctaatccggctgaactattgggcagtaataaaatgaccgaatttttgacttcggcaacgcgtaaattagatttggtgatcgttgacgcaccaccaattctgccagtgactgactcacagttgcttgctaataaagttgatggcacggtcttagttgttcgccaaggtatagcccaaaaagcagcggttcgtgatgctgttaattcattaaagaaatcgcaagctaacattttgggtacagtgttgaacgatgttcgtgatggttctcatcacggatactacggctataacagtggctacgggtattacagtgatgaagataaataatttagttgacttacattgccacatcttaccagccattgatgatggttcaccttccttagaagcgtcattggaattagcacgacaggcggtagctgacgggattcgctatattttagcgacaccacatcatatggatcggcactatctcaatcatgccggtgatgtggctacggcggttaaggcatttcaagcagagctagatgtaaatgatattccgttaaccatttttcctggtcaagaggtacatctaaatggtcagttgatggaaaaagtggacgatttgttgggtatagataccggtagacactatttattgctagaacttccccacgagatggtaccaagttacttggatgagatgatttttcaattgtcttgtgaggggattaccccggtcattgcacaccctgaacggaatgctcaaattattgccgaaccacaacgattatacaagttggccgaggatggggtcttggcacaggttacggcaacgagtttagttggtacttttggggaacaggtccaacgaaccgcaaaagaattcgttaagtgtggtttggttcagttggtcgcgtcggatgcacatacgctgaagaatcggggttttgctatgaccaaggcctacgaagtattaaatgaaatgaattcgaaatatcctgaacgttttgcaaccaacgctcgtgatttgttgaatggtgaacagatcgatactggtgagattgtgatgcccagaaaacagcgaaagcactggttgttttaaaagaaggagcgagttaaatgaaagcattggtaactggaggagcaggatttattggttcccaccttgtggaccacttggttgcagaaggattggacgttgtcgtagttgataacttgtccatgggggacctacataatgttaagcatcaggatgaagtcaccatttatgtcgaagatgttcgcaacgaaaaattcatgcaacaattgttacaggaagaacaacctgattatatttactttttagcagctgttgctagtgttgccgattcgattgaacgtccagctgaaacccattcagtgaatcaaactgcagtattcaatatgttggaatatattcggaagactaatttaccaattaaacagttcctatttacgtcttcggcagcggtttatggtaatctgccagaattacctaagaaagaagactcacgagttgatccattatcaccatatgcgattgataagtatgctacggaacgttttgtactagcatatggtgaactttatgatttaccaactgtctgtgtgcgtttcttcaatgtttatggccctggtcaaaatcccagttcgccatattcaggggtgctgtcgatcttgactgattgtctcaataacaagaagccatttaccttgtacggagacgggagtcagacacgagactttgtgtatgttgaagatgttatccaagcattatggttgataacgaaaagtgatactgagcatgaagtctttaatatcgccaatggtaatgaagccagcttaaatgccattattgaaacatatgagaaggttgcaggaacgtcattgcagattaaaaaggcgccagggcgtgaaggggaagtaaaacgttcggtggccaatatcggtaagttaattaagttgggatacacgacgaagtggtcgttagaagcaggcttgagcaaatattgggaaggggcgcaacaacgtgaagcaagtcgaaattaatgaaacagttaaagttggtcatgtacaaccacaaacggattatcgttttccaactatgattggaaagccagttacaggctggaaactatttgtaaaacggatttttgaccttactgttgggttaatcgggacggttttgagttcgccaattgtcctagtgtttgccattcttgtaaaactgacttctaaaggaccagcgttttataagcaagagcgggttggcctaatgggaaagagtttcaatgtaattaagctgcgatctatgtatcaggatgccgaagcgcgaacaggtgcggtttgggctcaaaaaaatgatccgcgaattacgcccattggtcggtttatgcgtaaaactcgagtagacgaactaccgcaattttggaatgtgttaaaaggtgatatgagtttggtaggaccgcgaccagaacggccagtgctgacagaggagtttagtcggcaattttcagatttccctaaacggttacgtattattcctggtattacagggtatgcacaaattaatggtggctacgatattacgccagacgagaaatgtaagctggataattactatattgaacatttttcggtttggttcgatattaagatgttattaggaacagtcaaagttgtgtttactggggatggtgcgcgttaatggtagaagattattcaggactgatgtcaatttatagtaaggaaagtcctgatttattacgaaacgcttttgatagtatattagctcagacaattcttccaaaagagtttgtgtgtgtattggatggaccaattggcctaaaattgacggaagtggtgaagtggtttaaatccgaatgtagtaatcggaatattaaaatagttttcgtgaaaaatcccgtgaactgtggtttaggaatctcacttgcagagggacttagagcatgtagttacgagtatatcggacgtttcgattcggacgatttaaataatcctgaacgtatggaagttatgcttaattatatgaatgaggataaaaaccaggatattgcggtcgttggaagtcagattgctgaatttagtgatagtcctcaaagacttattggaagaagaaaagtcccaataagtttcaatgaagtagcccagaaagtgtttttaaggaatcctttaaatcacatgactgttgtttttagaaaatcaattattttagctgttgatggttacaaagatatgccaggttttgaagattattatctatggatgagacttatagataatggatacaaaattacaaatgttcctgacacgctagtttatgcacatgttgatgggaacacatatgcccgtagaggtgggataggatacttacgtaaggaattaaaatttcaatattctgtgtattcgcaaaatattatcggaacacctacttttgtaagaaatatttttgttagaggaatcgtgagactgcttccgcaaaaatggttagctggattatataaactattgcattaatcagtttagagattaaggatgatgaatttgtatatacttggattagtgattctttgtttaattgctatttttttcaagagaaccattaatattttgaacccaatagttttattttgtgttatatgggggacaatgatttttctatatttaattccactttttacaagttttccaagtattactttacgtaagtggctgataatcgtttgtgcagtaggattattttgtataggagcgctattaacaactaagctatttcatgtacaaaaaattcaacataattatgtatacaatatgagaatattgttatatacagtagttgcactaatatcaattgtttttgtagccttttttgtaactgttattcagcttgggcttccacccttattgggcgggaatattaatcgtgcagactattacgtaagctatattgaaccgttttatttgctggtatttcctttctggtttttaagcatatacctgattaaaagaggatataagcctacgcttaatgtgttcttaatattatcgtcattgttattggtttttttgaaaggaaataagtttccactggtcttttttattgggctagtaattttttatttaggtgttgataaacgagtaaaggtaggacatttactttatctaacacttataattattggagtttttggtttatctaacacattcattaccaaagcaactgatcaagttatccaggcacaaaatataattctaggtgttaatattccaagtcgattaagatttgtggttgatcctattctttattttaccaataatttactcaatataactaatttttttgatgtccaatcgtcatactcttatggcgcacaaatgttttcgggagtttttcatgatttaggaattggtagcttaacaaatcgattgattgtgactaatgaagatttatggagtggtaacttgcaattcagttggctaacgacaggaagctatttaaaggtgttatatctagattttggatactcaggtatatttattggatctctattatatggttttgtatgtggtttgttttacgtcagggttcgagattggggaatgaataacacgttaattacattatatgtctactatctattgtttctgtcagtgttgttaagctttttcacgagttatttgtctgagaatgggttaatctataatttcttagtgattattatcattcatattttgtcccaaaggagaattagcaatgctgagtaattttcaaactaaggtcagtgtaatcatagtaacgtggaataatgaaagagatattatcagatgtgtggattcaatattaaagtatgagcatgatattgagataattgttgtggataataattcgcaagataacacagtcaatgttttaaaaaataaaaaggaaaaaggacttataattctggaattgaaaaacaatattggctttgctgcagcaaataatgaagggctaaaatatgcacatggtgaatatattttatatctgaatccagacacacaatttattgaatcaggtttgaatgaactaacaaatcagttgaatgatcgtgttggtctagtgggttgtcaattattaaacccagataaaagttatcaaccttcaacatatatgttcgataatccagttaatatcgttatagaacaatttcggttaggaaaattattaccgaaagtaatggcaaaaaagtatgcgccatatctaaatcgaatagacaagaatgttgaagttgattggttagttggtgcgtttttattaatatcaaagcgggattgtttaagaattggtggtttttctactgattatttcatgtatgcagaagacatggacattgcttttaaggtacataagttacaaaagaaagtcctgtttagtccagattttaaaattgtacatgttggtggaaattctgaaagacaagatgtttcaagctcaaaaaaggaaaagatgttcttatctagaaaagtgtttagtaacaagtatgggtataataatatacgaatcttttactggtgctatttaatcaaatttttactgttcagtttgatgggactcgcctctggaaaatataaaaagcgtggtcaagagtacagacggactttgaatatcctaaaaaagattgaggagtaagaaataaatgaagtttttaataatgaatcaacatacactaaattttggtgatgatattgcaggtgtatctttgataaatcagatattgaagttatttccaagcaggagcacagcgattcaaatcgtttataatacaccaggatcattgaactatccagatcaacgggtcagcgatagaaatgatgtattattgaaggacatgggacgagttcaaatattgctattcatgtttttttcttttcttggaattcaggttgtgtacaaaagtagtttgaaagcatttaagaaaatggtgcaggatgcaaatgtgattttagtatctcctgggggagcaaacctggggatgtacaaagattggcggtaccttatcaagctgtatatggtcgttatttttgggggacggccagtttttcataacaatacaattgagtatagtaacaactggttgtttaatatttttgagaaagtcatattgaaaaattcacgtatatatgtaagagagctgagtagctataatcatttacaagaaaaaggctttttccctgtgcgtggtgttgatacggccttttcatttgtaaatgataatactgatccgttagtatcgggaaattatatcgtatttataccaacaaacttagatagttggcatccgaattttagagaagaacctttaagtgatgaaataaaaaaaacaatattaaaggaactgtctgaattatcaaagcaaaagagccttccaattgttattctgcagcatatgcacgggagcgcggttgaagaaagcttatacgatgaatgtaagcggaaactagttgagtttggtgcaaaaacggtaaatattccacaaattgagaattgttatcaatatgacaatgttattcgcaattcgcagtttgtggtttctatgagataccatggaattgtaatggcaattaaaaataaaatacctttctgttcattagaatatgagaacaagatggctgaagtttgtcgatatgctcagttaacggatctgaatattaaattgaaaaatattgataaaaagtttaatctgatggattattatacgcttggaaccaaagaaatttcggataaaggaccattgattagtaagattaaggatatggcaaccaggcctttaaaacaattcaaatatggattaacaagtgagatcgattgatatggaccaagtaaaacagctttttaaaaatacacttatttttggtataggaaatataggaagcaagctaattcaatttattgctgttccaatgttcactgtttttctaactacaaaagaatatggtgaagcggatttgatgacaacaattgtgagccttgccttgccctttttctcactatgcttatatgatgctattttacgttttatcattgataatcctgaaaatgaagagagtattatatcttctgcgatttttgtgacggggattttggttggagttcttgcaattatagatgtattactgatgtttttgaagacaccaaacatatttttatatcgattagtaattatatttttaattgtacaagttattcaaagtttgcttgcacaatatttgaaagcaattggtaaaaattggttgtatagcgtaaacgggttgttgttatctattttaattctattgttttcttttgtgttttttcactttgacggaaacaagatatattggtatttttatgcgcaaatatcatcgtatattataagtgttatttttgttgaagtttgtttgaaggatagaactatatttcgtttagcctcagtgaaaaaaacatggataaaaaaactaactgaatatagtttaccactaatcccaaaccaaattatgtggtgggtaatgaatgcttctgataggcttcttgtcacatattacttagggctttctgtaaatggaatatatgcgatagctgctaaaattccagcattaaccaatgttgtgattacaatatttatgcaagcgtggcaattatcttcctttgaaaatgcaaatgatagaaatcgtaatgtattcttctctacggtttttaataatctattatttgttctaacacttttttcttccataataatgacattcttgatgcccattatgacagtgattgcttcaaaagcttattacacagcttgggagtatgttccgatgttactgttaggtgggatattttcaaacatatcaatgttcttgggaactaattatttagttggaaaaaacacaggtggaatttttaggacctcaattatcggtgcagtgctcaatgtgggactcaatatatatttgatacctgagctaggtgcaaatggcgcaagcatcagtacattgattagctatctagttgtttgtttaatacggttatttgaaactgataaggtgattcaaatagatattgattaccggttgttgctgagtgcgattggtattcttattgtgcaaattatttgtctatatatgcacgtattagttttacaaattgtgtttccaatactgcttatattgcttaattttaagtatgtttttaatgcagttaaaatgggaaagaatatagttaaacgttaatggagaatggtaaaaaaatgataccaaaagtaatacattattgttggtttggtccagatccaattccagaatatgtgaaagacaatgtggcgacatggcatgagaaatgtcctggatatgagatcagactatggacaaacgataattttgatttggaaattagtccgtatgtgaaaagtgcagttgagcataagaaatgggcatttgtttcggactatgctcgcctctatattatatatgaattgggtggtatttatttagatggtgatgtagaagttttgcaatctttgaatccattcttacattacagaatgttcactgggttggaagattctgatgcgattgcaactggtctaattttaggtgcagtaaagcaaaatcaaactttaaaaaaattgatggaaatttatgattctcaaggtgaaaatttggacagtaagggtagctttattgaaagaacgtgtgttgagcttaccacaaactactttcgtgaatatggttttaagaataaaaatataaagcagcatgtattagattgcacagtgtttccgactgagtatttttgcccgcaacgtccaggaacttataaggctaaaataacatcaagcacgtatacggttcatcattattctggcagttggttgggagaaaaggggattaaaaagagaattaaatatagattgatatttgtaaaggctaagattcgaaaatttctaagagtttttatcgggactagcaatgttgaaaagctgcgtaagggttatagaaaacggttcggacactaaaggatatatatgaaatataattatgtttgtattggatagcaattgattttagaggagacaaaataatgagtgttgttcaaaatgaaaaaactatgttcgcaatgcgtattgataaatctgaaaaagatgaattaagacaattatattcagacatgggactcgatttatcgacagcggttaatcttttttttaagcagagcctggtagagaacggcttaccctttcaaccaaggagagataagattaaaagtgaattacccaagtaacaaattggtggtgcggcaatggatcagtattatttgttttaatttgttgtaatatagttttttggtaagcagtaaataactgcccggatttaacaaggtgcataaataagctatgattacctcatcataataaatggtgaggtgtttttaagtgaatgaaaaatcagatatcgttcaagttcgtgttggaaaaactgtgcaagcaccaactactctatcgactaagtcgttacaaattaaagttggtagtaataagtctgttattgtttacaatcatattaaggctatattttggatgatttagtcaaggcggtgttcccgtgtgataattaatcagaacgaaattggacagatttatttggtatgcggaaaaaccgacttaagaaaagaaatcgatggcctagccggcattgtccaagaacaatgcgacttagatcccgttttaactcgttattaatcgtttgtggacagacgccaattatttcagcgatatcgcgattagaagccccttcggcatgtaaagcggcgatagcaccgcgttcaatttcagttaaatggtgacccttgcgatgagatatggtaagccgttcttgtatcaagacgaaaacctctttcattgtttgtgtaagaacttcaatgatacctgttatgatccctttatggttgtcagatgaaataatataattcatctgatatttcatgaagggattttcgtatgccaagatctagatattcagcagttgaaaagttagctctaattactgagttccagaacgctaacctttctgcaggtgcattcggcaagcaatatggaatggaagctcgcaccattgagcgatggtctttacgctatcaacaagctgacattgacggattaacagaagtcaccaagaataagcattacagtcaggctttcaagctgatgcttgtccaagaatatctgaatggtcagggatcacttcggatgttggcccataagcatggcttacgttcacataagcaactacgggactgggtattcaagtataatagggattaaaccataacggattcgccgtctagaaagcaggtccctaagatgagtcgtaaaataacttttaacgagcgcgtggaaattgtggaatggattaataaaggttcgcattcatatagtgaagccgctgaacattttcaagtttcttatcagcaagcccgttcctgagctttaaaggctaaagagaaaggatttgaagccctagtcgataccgtggccatagcaaaccagaatcagcgttaacggaactggataaggctaatcttcgaattagacaactagaatcacaaatcaaggatcagcagctcttagaggcattcgtaaaaaaatatcaggaacttcagcgcaaggggtgaattcacaatatcgactggcttaccacgcaatcaaggaggttagtcaaaataatcacggtacgattactaagtttttggcggtcgtaggtgtcagtcgccaggcttattataaagggctacatcgggacgttacggattgggaaattcgagataagtttttaagcgaacgagttcaatattggtatgatcaacatggtcaaagtatcggcagtaccaagatactatctaatcttagacgagatccagaagtcaccgaatcagtgacgttaaaacaggtcaaacggattatgaataagctggggatccgttgtcaggtccgtcagaagaaacgttcacgtatccagcaacagtatttacaagacaatgttttagaccaacagtttaacgctagtcgaccaaatcaggcctggttggccgattcgactgaattggtctatggagtcaatggccaatacaaagtgcgtctaagtggcatgctggatctttatggtcggcatttaatcagtttttggcacagcatgaagttacacgcagtatgtcacggccaggaacgccatatgataacgcaccaatggaacgttggtggaatgaatttaaggtacgctggatagcgcggcacgccagaccagccacctataaggagctggtcgctttagtcgaagaaggtatcacctattttaatcaattagaccgttcaccagcaagaaacgacctcactccagcagaatactggaataaggccgtttaaagtgaatcaaaacttatattatttcaaatgacaacttgacagggactagtacaaaatagggattctttttgtcttattgtagagagacgtgtaaactgatatgtttttgtaattccgaggtatcgtttataaaaaccatcatagttaaacaatggttcgtggaaaatatgactttcctttctttgaacattgaccactgggagaaaaatcaggttgttgaactttaacaaattgtagtacttatccatgtttgatttcatgtgttctgtacttgttagaacttgccgaatttacctagttcttaaatggtgtagtatcacgaggcatacaaatcaagacaactattttttgcattcgtcaaaactgtgttgaatcgttaaataacatgtttttatgtttcaaataagtgtcgtcagtatcaattagattattgaatgctgggtgccgtattgttcctttctgttggtaattatcatagtgctctaatatgttctgatttaagctaaacatcagcgtataattttcagtgaataagcaatagaaagttgaggtgttcttgatgcaatgggaagctctttttcagcaacagattttgagacgcgcactcaattattatcaaacgggtcatgtcaaaaagttcaataggaatcggcacagactgacggcggtagtacagggcgtacgagattatcaggttacaattgttgagtacgcaggtggcgttagcgcaatgacctgtacttgctcgtatgctagttcagatcgacattgcaaacatatggctgctgttctgtattttgcggaccacactgtgtcggttgggcataagttcggcggaaagtcatctgaaaattatcaagcagagttattcgaagggtttgctgatgccgatacaggcgaatggcgctcaaagtttatacaaaatttgcaaacctttactgtgagccagtgtgagatgttggctggtaaagatatgctggcaatcgatccgtccccactatttacaccactttcggatttaccgatgctattcaaggcttgtgagtggttggtgtcaaaaaggctaccccgaatggttaccactgaccaacaacaaatgagttttgatatattgacctatatttacctgaaattgtgttacaccggctttgatcagactaagttgattgatgagtgtggccgcttgcttagtcagttgctaacacattcagatggtcatattcgacggcaggcatttcgctggttgttcgtatatagcttagcgttaccaattaagtatagttggcagtttgagaacgtattattttatagtgatactttcagcaatccatattttcttaatcaaaaattggcattgattgatcacaaaattgataatctaaaagccagtcaccacgagatgcgatttcaaattgaaaccaccacaattgagtggacttattatcgcgttcgtgtcatgaaaaagctgaaattgacgccaagtgctgcccaaggtttttgtattcatcacagagatgaccctgttgttagcgattattttattgataattgtcgtgagcaaaatgatttgagacgggccgttgaatattgtcatgctggaattcaggtggcggcagcgcgcgatgattacgttatcatgaattatacctattcacaattagtttcactataccaagcctgtggaactgtggcagaataccggcaaatcctgttagaagcggttactaaatgtgatgctgtaaattctaattggtatgtccagctacgacaacaatatttgccagcggactggccggatgtgcgccggaagattagtgctggattaccgcggcaatcagattttgaatgggacgacaccaaaaatgtatttgtgaaaccatatatattggctctacaacaagaggtaaagacagctttaacgcctgagagccaactttttcttaccgaaaaactgaggtgtttccaggaatatcagggctcaacaggggttcaagtggcatactggctttggcagaattggtatcgacgttatcctgaacgaaaagtgttgatggatgcaattgatgagtggattgtacagaagatcgaaaaataataaggaaaattgttttaaatcaaatagataaataattaaagacgtttcttaacttatcgtcattaagacttagtggcccactttagacacaggcatcccggtttttatatgttttagatgactgttttaattaatgaaagtgttatgtataattagattgtgctaactaaaacgaaagtaagtgattatgtgaaactgattagttttggaatctctgggtttagagggttctcggaaaatagcatggagactatcaatattggtgatttgactgcattgattggaaagaatgatgccggaaaatctaccatctttgatgcaatggatgttttttttaacggaatcgggaacgctgatgctgacgattttcatattgaaaatgatggtacacaggcatctaaaattgtactggaggcaaccttttcttctgaaagttttatcgttcagcttgaaaccgttgatacagacttggaaaaagaagggctactagataaatctggaaatttagtaattaaacaaaccattactaaattaacaaaggcaggtgtaaaaacaagcattggtgcatacttgcccgatgttccagagttggctgatctatatactttgactaatagcaagttgaaagaccgtttcaaggaaattcaaaaaaaagatgatattgacagctggaatacgatttcaaagacaacaaattcgttgatgcgtcaagccattgtggcccattctattcagaaggattttaattcgagtgaaattatcgatgtcgacacaactaaaggggcaggtaaggatatatgggataagcttagtcagcaaataccagtgtttcagttgtttaagacagacagaaataataatgatgccgatgcagaaattcaggatcctttgaaggcggttacaaagcagaccttaaaaggtgaacttgcaggaaaactagatgaaattacaggtcgcgttgaagaagaggcgaagaagcaagccaaattaacgttagataaattaaacgagatggatccagatttggcacaccaattgactccaaaatttagtagtcctaaatgggagaatgtatttaagttttcactagatactgatactgtaccattaaataagcgcggtagtgggacaagacggttgatcttgttgaactattttagagctcaggcagataagcaggcagatgaagaacatgtaacagacattatttatgcttttgaggagcctgagactgcccaacatgcagatcatcaaagaatgctaatgcagtcttttagcaaaatttcacagcaattaggaaagcaagtcttaattactacccatagtccagaattggctggaatgctaaatccggatggggtccgtcaaattgagcacacctcggaagggcaaacacatgtgaataatactcctgacctgatgaaagttgcaaaagatgttggaatgttgcctaatatcgtaggcttaccaggccggttaaagatggctatctttgttgaagggccaaatgacgtacagtttttgcgtgttatactcatgaattattgcccgcagatatttgaaaataatgatactgttcttattccagtaggcggtggggcgtttcaacattggttgagtttgcaaattttggaaagattaaatcccgttaaattttatctgtttgataatgacgaggcagggagtggatatgccagaaaagttgaaaatgctcaaggtaatgccaaaaatgtatatgtttggagcttggggccaattgaattttattttccatattcttattattctagggctattgagagtgtcaaccatagtcgcgaggtgaatcaagatgatggcgcagggatacttacaaaattagccacggataaattccatgatgctgattataaaaaagatattgagccattaaagaacaacttgtggtctgatttcaaaagggtaaatgttgactctgaaaagaaaaaacaatttttagctgaattcaaaaatgatccaatgataaatactgagcttcaacagttgtcggatgagctatgtaaggcctataagcgtgactaagagggcagatgtgtaagatactttacagttatagactagccatgtattaaatatattaagcagttaaatctggtgccgttaatgggttatgcctgttttagctgctttttaggtgttatctagcttggataagtttgcgtaggttgattgtgaaatgccatagtcagaaagttgacaaatgaattccttgaaacatcaatataatacagatgcaaagtgagggttagttagcaattgcttttattagtattataataatgttggtaggtgttaatgaaggcggtggctgaaggagaggtaatcggctatgaatgatggatcatcagcagaaactgtacaaagtatttttgaggcgagatatctagaagaatacctggattttgacagattgagaactgcaattgcacacaacccaagaatcctttcaagcgagatgttaaaagcagattttgggaaaacagcaataggaataaccaattttggcaaactttataatactttttttaggcctagatttgctgagacaggaattgatgtaactgagttagcttatgaaatttttaaggaaatagatagtgggcgattaacgaatgtgtatattgatattttggataaggatgtagatgaggacatagatgtgggaaaagctgctgagtatttgaataggaaatacaattcaaatatagatgtcgggcttaaaagggttattgagggtaaacacaatggttacaataggattattgatttttcggcacccaggtcgaacagtctcagtattccggcagtgtttatcaaagaaaatcacttctatgcattattcagtgtggctacagaatttaatgataaattagaaacaacaatcgcaactgttgatgttgatttagacagaggaattgtaattgttaaagcacgaaacaatcctgcagtaaatagtgcaataaatagaagtgaggctaagactaaaataccaaactgtccagatatggcatttggtccagactggctacataagtttgcgattagtgtagtattgggcagagcactggcattaaaaataaggccccataatattggagcggaaaaaatgaaaatgtatcagatgcacactgagttagtacaagccgttctgaaaaggccaatggaacagttagaaaataagactcatctacatcagaagattcttagtcatgttcaagagatctgcggccttaaccgtggcctgtatgccaatgatgagattcaacagaacatggtagagcatatatttaatatttatctttctagatttattacgcgttcgtttagtgaaacgaaattaagaaacggtgctaaagaaaatggtgcttttggctttgctaatacaattgctttttctggaaaaaaccatggttctggaaaaatgaaatcaggaggacgggccaagccactaatcggaaatgagttgtactttgatgtaaaacagtcgttggaggaaaataaacagatagcccagtggaatgtatcttggtttgattgttacttatatgaagatgataccttgactgcaggccatttttgtaatacttctattcggtgtgagaaagacttgtttaaggtggtatttcttaaacataaactagattcgattatgatccatagggttactgaaaagttattgaattatttagttagggaggatgaaaagaagtaatggtgtttgacgagcaactacagactatactcgcatatgcgaagcgtgcggagtgttcaaccgaattaaatgaacagcttaaaaagactacgattgcttctaagcttgtcgaagttttacttgagagcaaaaatggtattgtttactggaatgaactcaatcaatattgttttaagaatgagtttgtggaaagtgccacttttaactctgaattcagcgcgagcactgttagcatgttacgtgaaaaacagtggattgaggttaggtatgactacacttgtgcaggtgaagagtatgaacaaaacatcgctgagaaaaaatgtgagaattgtggcgaaatggcttgcaatcaccaggacttttacaaggagttaagattaaggttggagttggtggagactctgagtaaacttaatgaagcccttgtcagcctagtaattgatggtaggcaattggtggttttaaatgagataagtaaacaaagatcttcattggttccatttttaggtgcaggaatttcgtttccgtttggtataccatcgtggtcggagctattgtattcgttaaaggaactgctaccattgccaaatagtcatgaatttcatgaaattagggaagagtatcaaaggttatatgaaaatgagaatgtctttggtatgctggagctgttggataaaaatagcgaatatataaagaatgaaactcaacttcaaagcaagattggcagttatattagtaatattgaagactcgctggacttatccagttattgtcagaataatgttcaagatgttttagacttgaacacaccgcttatcatcacaacgaattatgatgatattgttgaacaatattatagcaggtacagaagtggtcatggcatgggtagtaagcgtcttaaatcgataacttttagtaattttccgggattgagtcagctacaagaaatgaaagcaattttccatattcatgggagtatcgattcctattcggatattattctatctgcaaaaagttatggggaactgtacagtaatcagaccaataatcaaagaattcgagatgttcttgcatcaaagtgtcctatatttattggcttttcactgaatgacaagtttgtcataaatgaacttgaacaggtaggaaagctaaataacggctttttggctgcgtacttattaacgctaaagagtagtccatctcaaaaacttcctgagtcactgcaaggaaaaattacgtgtattcaaattgatgattcaatagttagtggtcctcaaccaataaagggaataaatatttgggttgtgggtattcatttggtttgtatgtatataattggaaatatttatcttccaaattatgaataggagagctagtatctaaaataattggtacctccatcgtaagtaattttttagtgtgatgaatttggctagagactctcaaaaatgatacttatcttcacaaactaatacccactcattctacaatcccccctaaaatcaggtttaaatattttatcctaaccaccacgtctagctataatcaaactagactagtataatgaaaaattacttgaaacggctagtcagtttaactgactaattcggattagttttaagtgatcataacaatttgggggaagcttatgacaaaaattgcgtgtgtgattgtgacttttaatcgtaaagcgctacttgcggaggctattgagagtgtcttgacgcagccggaagcgccagaatatgtcttcgtcatcgataacgcatcgacggatgggacggaggcgtttattcagcaacaatttgactttgatgatcaacacttggtttacgttcgttgtcagcaaaatcttggtggttccgctggttttgcaactggaatccggctagcattgcagactgactgtgattggatctcgatttctgatgatgatgcgatttttcagaccggctactttgcggcgatgcggcgagcgattgtgactcagccgcaacaaggcgtattttcaggatcggtgttattaccaaatggacaccatgatgcgatgcatcgtgaaatgattaccaattcgcaaacactgacggttaagcccatagccgaagccgactatgcgcaggactttaagtatgatattttttcgtttgtgggtatcttaatgaatcgcggcattgttgaacgaattgggctacctgaacaggattactttattcggtttgatgactttgaatatgcgctccgggctcgcaagtatggtcagtttctaaatgtccacgacgcgttggtcctacacaaaacgacgtatactcgtactgctatagcgccgtggaaggaatattacgtgatgcgtaatcggctggcatcattattcaaacaccgtgggcaaactcgggttacctgctggtatgcccgtcgctttttagcgcgcaaattattcgccatcttgctttttcgggatagattgggccaagcggggccactgataaaagcgtatgttcaaggttaccgtgatggttggcatgaccggcttgggcgcaatcaagattatttaccataaaggacgttaggctaagacaaggagtggacaaacatgcaatatggggcgattgtggtaactttcaaccgcaaacaattactaatcgaatcaattacggcactactgaatcagacggtcccacccgcgaaaattattattattgataatcattcgacggatgggacaaaagctgaattacaaacagctgatattttggctaatccaagtgttgattaccggtatttgaccaaaaatatcggtggtgctgggggctttgctcgggggatgcagattgcggcggcggatccgaacttggattgggtttcaatgtccgatgatgatgcaatttttgagccagactattttgaaaaactaattgcttatcagcaagatcatccaaatcgccaaatcttgacggggagtgtgtatattgaggatggccgtttgcaagcggatcagcggaaccggttcaccaattggagtacctttcaagcgcaggcggtccctgaacgtgaatatcgcggtaattttgagtttgaccagtacactttctgcggtgttttcatgagtgtggccgtgatcaagcaagtgggagtggcggacgctggctactttatctggtgggatgactgtgagtacgcggtacggacggccaagctaagtcgaccggtcaatgtgagtgcagctaaattaattcacaagacggctttaccttccctggacttcaagtctaaattcgtacccgattggcgactctattacgggcagcgcaatcgcttgattacgattaagcggtggcgtgcaaactcattggtcagtctcggatggttgcttggattctacgcccgattggccattcaactctgtggaccgttttatcgtggctatcgcaaaatggttatcagagtttacttggaggcgttacgtgatgcgagtcgcgagcgtgagggcttgaatcccaacttcatgccgggacagaagttttagtgtgggcctgatcgtgagctgtctgatgacatgggaactgtatacgggcgaaaccagtgattattgcaatttaaggtcagattactaaaccaggccgactcaattttggacatcagcttcatcattattaacaacgaattaaaagctagttgtgctgagaaaaaacttcttggcacaactagttttgtgttttggtgacattttagacggaaaagcaaaatttaatttttagatttattttgtaattcgaatggataattttactgtttttacagcaacgtttattggtcttttgaccagtgaccaccagaaagcattcagatgattgcttgtatttagtcgcaatggttgaaaccggtaatcataatattatttgttatttagatagtaaacttaatttagcaagccccaatatttgattaaaacccattatatccgtatgttgagcgattgtttatcacgtaatgtttgttataattcaccaagaacaagttaattttgggggaattcacatgaacgaacaatacgattatttggtagttggtgcgggactatttggtgccgtctttgctcatgaagcagccttacgtggtaaacgggtcaaagtgattgaaaagcgcgaccacattgctggtaatatctacactaaggaagtggcggggattcaagtccaccaatacggggctcatatcttccacacttcggatcgtgaaatttgggattacgttaatcaatttgcggaatttaaccgttatacgaatagcccagtcgctaattacaagggtcacatgtacaacttgccgttcaacatgaatacgttcagtgaactctggggcgttcggacaccggcagaagcagccgctaagattgcggaacaacgcgcggcggcgaatctcggtgatcaccaaccacgcaacttggaggaacaagcaattgcgttgattgggaccgatatttacaaaaagctgatcaagggttatacggaaaagcagtggggacaaaaggctacggatttaccagcgttcattattcggcggttaccggtacgctacacttacgataacaattactttaacgatacttatcaaggtattcccatcggtggttatacgcagattgttgagaagatgttagctcatcctgaaattaccgtggaaacgaacaccgacttctttgcgcataaggctgagtattttgcccaatacccgaaagtcgtctttaccgggatgattgaccaattctttgactatcagttaggggaattagcctaccgttcactacgttttgagactgaaaccgtgcccgtggataattatcaaggtaatgccgtagtcaattacactgatgctgagacgccgtatacccgggttatcgaacacaaacactttgagttcggtaagggcgatgcggatcaaactgtaattacacgtgaatttccagcgaactggcagcggggtgacgagccgtattatccggtcaataatcaaaccaacaatacgctctacaaacagtatgcgaagctcgccgcggctgaaccccaagtcatctttggtggtcgactaggccagtatcgctactatgacatgcaccaagtgattcacgcggccttagtgacagtcgcgtcggaatttgcaacgaccaaataaaagaatgtgtgatgattgaagatgagaaaacggctagcaattgtgtgggggagcctagcattgctcgcactattattgggatatgcttgctacgccctgagtattcagcgcggtcaagacacggtcacgcggatttatcaaactgatcaaaatgggacgccgattatttcacccggaccaattaccttagtaggtaaggtcaatcaccgcaatttatttcaatctggcattaatggctatgtcttaacgaatcgcgatccattgtcgactttgttgccgcgccgtaatcaaacagtgcatctaaagtatcgttctgcacagacgacggtggagctacgcaagacgctacgtcaagcacggtatttacaggccggtactcagaataccgccacgccggtctttcaaaatcgacagcagcgaggtgatgcgacaacgtacggtcgtatcagtaccagccaagacggccggatatggacgaaactacccattagttatccgcatgtgcaattgtcacggccgagtgtctggtacgcgaatggccgcttgacgttgatagatgggaaagaccgttactggacgactaattttaaagattggcaacatcaacggttgaactttaacggggctgattttaagcaaggtcgggttcaggccgtctttccaggtacgactcgttcagcggttgttgtggttcgcggcattgatcgccaaagcagtcgcgccaaactctattatggacagctcacgaagactggacgggtcaaagcttggcacgcgttacaactaggaaagctcccagcgcgccaagttgctggaatgagcttgattgatcaacacttatacctgtttcgtcagcgcggtacgcagttggccgtttatcgtgccaatcggttgacgcgtccggtcaggttggttggtcgcgttaagctaaatcatgcgcagtcacaacgagtgaccgcggtgaatttgataccgaccaccaagcatcgctaccggttaatatttgacttgacgacagctgaaaaggttcagaaacagccacgttatcggttgcttgatcggcgatttaaagcagtggggcagcagcatctattggtcactgattatctctggagccaatttcaaattagtctacgtgggagtgagtgaggcatatgaaggtacagccaaaggaacgctttagtttagcgtggcggtggttgccgttcgaattgctgatcattatgctaagcgtcggccttggatgggcgggcaatcgatggctacctaagccggtgtatcaagcatctgttgatattcagattgcgcaaacgccacgttcagggctgtcaacagcccgtctaaaacgtcagcgacgccaggatatcaaagctatcacgcagttcaacgtgatgccacaccagagtgcagtgctgactcgagccagcacttatgcctatgcgcattatggcatttggcaaccgattcaggaactgagtgagtcggtccaagcggcaccagttgcgcggcgaccggtcttgcgagtgacagcaacgagtagttcacggcaagtggcccaacagaatgctcaggcgttcaatgtggcgattaaagctaatctgacgggcctaaaacattatcgagtgaagacagttaaacgtaccgtaacgcgtgagacgaacgtgatccgcggggcgctttggaagttaatattagttgttgggggcggtttagcgttgctgagtccgtacctcgtgaaatatggtcagggttgggggcggcacgatgatgagacgtaggggagcaagtatacagcagcaccgtaatgcgctctatctgattatctttggaatctacttagcctcagtcacactgcagacgacgacctttaacgagatgataccgcatcgagcgggcgttttgattgaattagcgactttggccgcattgctgggcctcgtggtttgcttagatgccttgacccccggccaaattattggcgaagtcagtttacttgtactggtgactgtcgtgacgctcacatcgggtgcgcattatttgatgccgacaatcatgttggtgattgcagcccgggaagtttcgtttcggcagatcattcaagtttatctgggcgtcgtggggacgattctcttgttagcgctagttgctgcggaagtcggactgattaaaaatattacgtttgcaactgccgatgggttacgtcagtcgtttggtgtcgtgtataccactgattttgcggcccatattttctatctgtgtgcggcgtatttatacttactggctcgtcgttttcgattagtagcgctattacctgtgttgtttggcttggcaatgatttaccagtttacgaaaacgatgacggatgtgattgctttaatcgttttgatcagcttgtacttggtctatatctatcgccgccagcttcggtggcttcggccgatgattcggtatagctttttgatgttaccacttgctagtgggctaattattgggttgtcgaatatttttaattatcaagaccggttgctggtagcgctcaataataccttgtccacgcgactcgcgctagggaataacgcgttattagcatatggcgttaaattattcggccaagccccgattccaattaatggttggggcggcgatcgggttgaaacgtttaccaatggtgttggtgatgcaacgtatttcttcattgactcgtcattcttaaatatgttgatttcatacggattactattaacgctgattataattatcggtatgacctggtttttgtatcaacgtacgcggcaacacgactatttgttgccggtaatctttgtggccattgccatcagtagtatgtttgaccagcacttcttagaagtaacgtataacgtctttattctgatgttattcgctgatttaccaaattatcaaacggcagtcggccccgcatttgaccaacctgtcgttattcgaaggggggcgtcgtgccgatgaatcatcaacaggcttatcgggtccagcggttgatcctgatcatcgccctgatgttaattctattcggtgataccgggatgaacgcggtatttagttttagccaccaaccacaaagtatctggttctatccgcagctcgtcattgcattaataacggcagcgggccccaacttattgttgatggccctgggcgcctatcaattgcggcgcacggcattgaccgtgccacagttgattcgccgagtcttatggataataggcggaattaccttattctcactggccttctatcttgaagacttggtgacccaaggcagtttaaatagttttaacattgccggctttttaaccgcgttagcccaagcgcccgtgggcttttatgacattttgtatgagctgttgggcttctttgtcaccttgccgttgttaagggtgattgcacaccatgcgagtgttgcgattcagcaatacctattttgggcggagctcgtatttattggcatggtaccaatcttggcctatttcactggtttgacgacgatcagtgttaattcgccgctcgcgattacggccggttgcttttttgcattgatggggtattggttgagccaaacggaggtgttacaccggattacgcgagaacatctcttagtggcgtggctgctgacatgtgggtgctatgccgtgatggtgtcggtcacgatgtatcaagtgaatctggaaaagaattttgaccttatcagcagccagccatttgcccaaacctttcaggcaattccatgtttgacgctgtgggtgacgattgccacctggatgatgaaccggccacggtccaaagcagtacgccggcataactttgttcaaacgggttatggtgatatgctggtggccggtctactgattacaccatttatggtcattaatcggttgctgacaccaattattggtgcgtggtggtctggttggctctggagtatcgcggtgctgatcgttagcgttgaactagtatggttattacgacatgtccgctggttgcaacggttattaccagatttatttggtggctcccagttaataggaggctctgttaatgcgcaaaagaattgagtggatcgatattgcaaagggaatcgcaattttagcggtcgtgattggtcataccttgggcccctataacgggcaattcttcggtagtttgatcttcgcctttcacatgccgattttcttcatgttgagcggttatttgtatcgctcacgcccggcacgacaagaatgtcagcgtggcatcattaacctattactaccgtatctcgcaacggcagttgtgctcttagtcgtaagtgcgatagcccgattattaccgaatccgctccttaatgcgtattttccaagctggcgacaaggactaattgccacggcatacggggccggttcggcagtgttcaatccgtggcactggcaagttcaaccgattggggccgtgtggttcttgctcagtatgtttattgcgctgcaactgttcaatggtgtgatgctactaacggcccgacgtcatcagcgctggcgtcaggccattgtacggggcggggtgttcgctattttcgcaatcttaggtggttggctcggtcatgccgcttatttaccgtgggccgttaacgccgcgttgttagcacagctctttttatatgctggttacctcgttaaacaaacagccctgctaagtcggatatcatcagcttggtatttattattcacgttcatgtggttagtgagtgcttttcagggttattttgcgttgacagttccaacatcgcctaatctgttgattagcgtcatggggggcgttgctggcagtttgtgtatcattcgcgtcagtgactggcttagtcattatccgaatgcgcggccgattaagtggttaaaacgctacggtcagttatcgctagtggttctgtgttttcatttgatcgatctaaacgtgattggcattgaaggatggttgacgaatcatttgattacccatatgggaccactcgtgacgacgatcatcgcaatcagttaccggattggcttcgtgacggttgccatgctggcaattccgcatcttccgggaattcgagcttgttttttacctcggcagtatctatttcgccggctacaacgtcgttaaattactgtgtataatccggcaaataccgagataattaattgacctaacagtcacgtgcaaatacttgcattattaaatgatggaaaatttatcatgatttgaagcacaaatttcataccagagggggactggcaaatgaaagtacaaatttatgtagcggctcataagccgtatcaaatgccacaggatccaacttaccgacctatttttgttggtgctgcgatccatgggggtgcaccacaaaattatcaacctgataacgtcggtgacaacatttcggcaagcaacccgaactttaacgagctaacggcgatgtactggatctggaagaactgtcatgcggatgttaagggtttgaatcaatatcgacgctacttgtctgaggcacctaaacgcaaattagccggtattttatcaatgaccgaaattgaaagtttattgcagcaatatgatgtcatcgtaccaaaaaagcgccattattatattgaatcgaattattcacattacgttcacgcacatcatcgggaaccactggacatgatgcgaacggttattagtgaacgtcatgccgcctacttagatgattttgatcagttgatgcatcaaacgtcggcgcacatgtttaacatgacgactatgccaaatgggtctttgatattctgtttgctgtgcgtgaccggatcgatattgcggattacgatgtccaagaagctcgcgttttcgggtacttatctgagttcctattggacgtgtggatcaaccataaccaacttaagtacgtggaagtcccggtaatgtacatggaaaagcaacagttaccggcgaaagcgtataatctgttgaaacgtaagttcttcccacaagctgctaaacggactcatttttagggtaccggcgattaattagaatattgaagtggtaagtgggagtcagccgctgatgaatgatgcggcatgccaattaatgagctaacgacttaatagtttaaaaatgcgccactcactagacgatgatcggtctagtgagtggcgcattttaagtctgttgtataaattagtaattgaacgtagtggttattacatctgggttcgcaatttcgcagcattagtcagtactggcggctgaagcaggaacaatagtccgacgtaaatcagggcaccaatgccaatctgcaaggccagattaaggtaagaagcggtcatactgatgttcaaggcgtaaacgacggcgaacatgaccacaccggcgagcacgtacttcaaactacccgtaaataattgtctggtcgccaacgtatgtcgagtcacgactaactggtagccagtgacacaaacttccgaaatcaaagtggcgcacatggcaccggccacgccccaaaaccaaataagtgggatgttgcaagcgatgttgacgagggccccgatagtgacggaaatcgtataggtcttagtttgcttagtcggtagcagaaactgctgaccaagcacgttgctcatcccaattaggatgatgacgggtgcctcaatcatcaacagtcggtcgactgccccaaatgcccgtccaaaaaataggggtgcgagcgtcgttgcgaccgctgccacgccgagagccattggaatcgcaattgcgagcacaaagtcaaaggacatgtataggtattgtttgacgcgttcaagttgctgcttcatgaagaggttggcaatgtggggcaacatgactgttccagtcgccgtcacgagcgctaaaacgagcttgatcaatttgtcggagtaatcataaaatccggcggcggttagcgaatccatttgccataacatggtcttattcaaggcaaggtaaactgtcgtggcgatttgtggcacgaataacgctaatgagggccgcagatgccggaagagattcaattgacgccagttgggccgttcgacactatgtcgtaagtatggccacagtgtcagattgcccaaaacttgtgagcccgctaaaatcaaaatgtagattccggtgtcttgccgagtcttcacgaatgcgaaaatcgcaatcacagaagcaatcttgacaagcatgttacggagtacggttttcttgaaatcctcgagacccataaagtaccaagaaatatcaacagcacccgcaatgatataaaatgattgatagaaaaaataaatttgcaattggtgctcaaaaaaaagaaaaactaaaaaggcgagataagcacaactgatggtcaataactgtaatatttcaatttcccaaaaagtttgggagcgttgccctcgattatcgcgaataaaggcaatttcgcgattgccataaattgtaataccgaccgttccgaacaatagaaagtaagtaatgatcgaattggtcgttgcattgataccgacgccggtcggccctaaaacccgtgagatatacgggacggttaggaggggcgtgagtaaaattaagaggttataccccgctgtataaaagtaattccttatgattcgcatgagtggctccttgtggcagttaagcagtctaacgtcgaatttctcaacattcaattcattgtatcacagccaattagccggttgatagtggttttaactggctagggttggttattaacaaacttattattttataaattagaaagtatttttattgttaattaactgcggagcgacatagttatatcaacgataattaaattgggagactggcgtaatacttggagcaccccagtgagttgtgttcgtgtgcacttatgatcaaggactgaaaatttggccggtagggtcgtggaatcaatgatgattgcaggagaggggagatgattttgatggtatggcgagcgaatggtgcgtggtgtgttcaaatcaatgggttacaaaaacgcacaaccaaattcccccttgagtttggttgcgcgttttgtttttatgtttaataagcgccattaggcttgaacataatgaccacggtcttgaacaaaatgtagacatcaaatgcgacactccgtttagaaatgtaagttaagtctaacttaaccatttcatcaaaaccgacactgttacggacggttgcttgccataaaccggtacaacctggcttgacggctaaccgttgtttgtcatagtcggaatattcttcgacttcccgtggcaatggcggccggggtccaactaagctcatcgagccttgaaggacgtttagcaattgtggtagttcatcaatgctatacttacggatgaatcgcccaatcttagttacgcggggatcatcctgcattttgaacatggcaccatcaatctcgttatctttaagtaatttttccaacaattcatcggcgttggaaaccatcgagcgaaatttatacatcttgaatgggacttcgccacgacctaaccgtgtctgcgagtagaagacggcgcctttaggatcttcaactttaatcgcaattgcaattagcaagaagagtggtgataagatgatgaggcctaagaggctagcgacaaagtcaaacacgcgtttaatgaaccgataaccataacgacgatgctgacgcccggcgtcaatcgtaatcggtctgatttctcgttccttcaattccataagtaacaccctatgcttcctttaaatattttcccccgtaaatcacagccaggttaatctattactactgttcgggttaccacaaactgactatgtatgaaccatattgatacaacctaatgattatagtacaaaatagctatcaagtaaatatgcttgatacgattaactttgcagccttgctaatctcattatagcaaatattgtactggaataaaccaatatttaagctgtaattctttgagggttagatttgactaattgaactttggttaactataatttaccagcatttcacccagttgcaattattagcaacttaaaagcgcgcaactgttagtaaaagtggtgcgtcgtaaaattagttaatgaacagaaaaaatatcagctacgtattctaatgagttatgggtttaggcctaataattgtgaccgggataaaatatgaggggaaagtgaatcaatctatgaaaaaataattgaggtgattatagtactaaaaacggtatgatagtgatgactctgccaattggtgaataaatatttgctaagcattaactatgtgttaacctagcaatcgcgtaatttaagacatacggttagaataagttataagctgaatgaagcgtaaagagctcgttcttatcacggtcattaagtagaagatagtccaaattaatgaatctttttgtggctatggttacaatggctgctgatattggcccatcgttcgaaagtaagctggcaaattttaggttgctacggtggctttctcgcgtgatttctcacacattccctctaggttttcaccaccgttcaaggtacaattagattagagctcaaattcaagtgaaaaggatgtccgatatgaatgacgattggatcacggtttttcccgcggattataataattcgtaccacttaattttgaaacgggggacggcccattatgcgtactactactttaaggttgataagctagatcaacgggtcattttctatgatgacattgagcgtagcggtatttcaatcaagactcagatcacgcggacgtttatgcgggcactggttaaagcaattgattggcatccggtcggtaacagtattattatcgagatttaccctgtcgaccgtcaagagacgaaggcaatgcggctatcttgtgatatttagctctgaagtgattgccaagagtaagacgactttaaatgataaccaaagaatccccggtcaattactgaccggggattcttgtaattgcaggtaacgcgaggttaagcctttggtgcagtgacgattggtgtctcgatggtttcgacgtacttagcggcaagcggttcggcgactaagttttcgccatccttcacgaatagcttggtggcagcgaggtccgccattgccttgctaacaacgtctttactcaagttgtcgttggcgtagtgtaacttcaagtggtgaaccttgtttgtgctagtcttaaagcttaagtctaaagttttcatgggcgcttcctcctattattatgggtgtgttaagcgatgggttgtggatcgtagcggtaggcgttggccaagttagcggccgtgaactggtcgcccgtcaagacttcgacgatcttgccaaaagcggcaagttgttcgtcagttgcgtcttgggcgattgcgttaaaggtttgcttacgttgttcgtccaattccgtagttgtttgaacagtcagggttgcttttaaccaagttttagtcatgatgagttcctccttgaattttgtggtggtaggctggccagcttacattaatacagacggttgagcctgacgatttgtgcaagggttgcctaaacttttttgactagccccatttaatccgcaaactcggtgatggttcgaacggtaatactgatgagcttttcagcgaatagtggggtcagaatggtaatcaagctagtaaggtcgctgtcggtcagttcgcgacctgctaaccagtgttggtggaactggcgttgattagaatcagttactgtgagcagtacatgtgtgttcatccaaatatgcatcgtgagttcctttcagactgcgacagtctcattagttaattggtggtttgttgctggtaaagcttgtgggccttgacgagcagactggcccgccagttgtagactgttcggcggctgacctggtggcgccgcatgatactgctaacggtctgttcctcgaaaaagaattcggtgagataaatccgctcacctggccgacattggacaaggagttctgttaagagggcggttaattgccaatgggtctcttgttcggtcatgggatcaatggtaatgggcagtgcgtgttccaagttgacttgcgactgggtgcgcaaagtttgtttacgtagatagtcgacagttcgccacttgatacggcgaaatgcaaatttacgaaaatctggtaaattagcgggcaattcgggcgcgtagttctggtaagcagacagccaagtcaggtgggccacggttacacaatcttcgaattgcgggtggtatttggtgacttgggcggcttttaaagcgccgtatagtaaatgttggtgctcgggtcgggcgagtaaatcgaaagccatttgattatcaaaacggtcagcgtgcatctaaataaccccatttatgagcgatttccttggccaaggttgatatcagtgtagcgagcgatcgcaactgacgcaggtcgtgaaaatggactgaaaagtgacgatttattttcattattaatgttccaatgagatttggatagattacagaccaactactttcctagattgtacgtaattgttatgatgtgattaatctaaaataaccgcggacagcgggggctcggctggtgaatgttagagagaaataccgactttgagggggatttaccatctatgaaccaaaatattgacgttccacatcacgttaacactttttggcagtgccacgctggtacttgggacacccgacagccacaacgattattagtcatcgcgcaacgctcagaacttgccacaatcgacgtgctggagacactttttctacttgacataaaacacctgacatgtgttgaaaatacgctaatctttgatcgtcaacggggattgatcaagacaaaactgacgacgcgccagatcatgatgaattacgctggccgtctggggttatctgggacacagttgatcaagcaactcgccggtgaactcggtttatcgaaacacaagttacctgtgattcacggtgatgcgatcctgatgccgttaagtacggccaaacggggaacaaccagctggtacaatcggcattatttgaatcatatcgaggctcaaggatttatgacggccttagtttatgatggtcaaattacgattcaagtggatatgagcgagcgcgtggccactcgccaacttgtgaaggctggtcaattacaagcggcgctccaggaacatcatcgtcggcgattagtgcccgatcaatcggtaccttcaatggcggacacggatcacgagatgatgcagtcgtatactgaccaagtcttaaagcactttggcatcttagcacttcctggagaaattagttgtttgacgcggcgatttttcggtaaactataggagtaaagattaaatgatgggagttggtgtcgttgactaagaaggtcacgaagattgtcgcgcaaaagcgagctggacgttataacatttatttagacgagcagtacgcttttccaatcagtgagtcggtgatgatcaagttccgcgtttttaagggcatggaagttgatgaacaactgcaagcagcgatgattgcggcggacgatgtctccaaggcgtatacgcgcgcgctggattatctctcacatcagttgcgtaccgaaaaagaagttcatgacaagttacgggatgaagaaattgacgagtcggttatcgacgcgacgatgcaacaattacgtgagttgcggttattgaacgaccaacagtatgcggatgcctttgtgcggacggccaaacggaccagtgacaaggggccacgggtgattcggcagaacttacgacaaaagggtgtgggcgagcagctgattgatgacgcgctggccgggcagtttagtgctgaagagcagatcgataatgctagtgaacttgcgcgtaaactggcaaaacggtatcaccgccaagcttttaagaccatgcaacagaaagttcgccaaggtatgatgacgaagggctttgataatgacacgattacggccgcgattgcgagtttggcattagaacccgacgaagatgaacagtgggaagccctcgttgcacagggggcaaagttgtggcaacgcaatcgcaagtatgcgtttcgtgaacgcatgatgcgcacgaaacgcagcctgtttcaaaagggcttcatgatggacgatatcaatcgatttatcgacgaacaagttgctgatgaatgaaaaggttgaattacctgcccgcacgccataaaaatctggtataatgtttaatgaaattcgatgaaaatttaccctcattttagaaagttgggttaatatggcgcgcgaggctaagggacctaaggaaggcgacttcattacgatcaaaagctataagcacgacggaagtttacatcgaacttggcgcgatacaatggtactcaaaacaagcgagaacgtactaattggttgtaacgatcacacactagtcaccgaggatgatggtcgccggtgggtgacgcgggaacctgcaatcgtttattttcataagcattattggtttaatatcgtggcgatgattcgcgataacggcgtttcatactattgcaacttagcatcaccatacgtgttagataaagaggctttgaagtacatcgactatgatctggatgtcaaagtctttcccgatggtgagcggcggttgttggatgttgatgagtacgaagaacacggtgcccaatggcgttattcggctgatactgatcgcattttaaaagcaaatgtgaaagtcttagttgattggatcaaaaacaaaaaaggcccgttttcacaagactacattgatatctggtatagtcgctatcaagaattatcacgtcggcaatagctctgctgacggtctgtcagcggcgtaattaaagtacaaagggagtgactccgtgctggggtgctcccttttgtgttctggttgcgtctcgacattgaataataagaggtgattaccagccgtcatggttgacacaagtcatgataattaggacaataaaaaaaacgacccacaagtcgcctctgtgggtcgggtgaaaataggaattacacgtttaagcgccaaagttgactggtcgtgaatagccaaccgcgtgccaccacggaacgtagattttttcatttttgacaccattgtcctgagcgtcaatcatctttccaccaccaacataaataccgacgtgtgatatcgaacctgtgccactaccaaagaagactaaatcgcctttttgggcgcgctgtttggaaattttgggatattgtcggtactgagcttgggccacgcgtggtaaggttttctgcgcagcttgctggaagacatacttagtgtaaccggaacagtcgaacgtgttcggaccgaccgcaccatagacatagcgatggccaagtttggatttggccacgttatagaggttagtgaaagatctggtgctcttcttgagggagccggtcttgacccagccatgaacacgggtattagcactcgttataaaataataattagccgtggtattattagctaagcgaatttgccgttgttgggtgacaaaccaagtggtattaccatattgtcgcagcgttccccgactctggattttaagattatttgcggcaccactcatgttatagaagccgtcctgagtattcttcgtcaggtaggcgcttttagtaagattagtggttttaatgacgcgattcgttgagctggcatcgatgtttggtgcttgccaaagccccaccgtgaggcctaaaatagcaacaatcagtgtgataagacgttgtttcatatgtatttcctccccgaaaatccccatgtccatctcattcaataacgctgaccccatcataagcgctcattgtaacaaagttgttgcaaatgagttgcggttcgattaagtaatgtcaacagcttgagtggattaacaataattgattagatcttgaccgataggagtgacgaacttggcttttttgaagattgataacggtgaattacttaagaatattcggcaatttgccaagaagaatggactgaccttagcggaagtggcgaccttagcaggcttaagtgcgagtgccatctatagttggaaaaagcacacgccgtcagtcggtacgcttaaggaagttgctcaagtgctcggtacgagttataccaaattggttggtaaggataaagaaccgacagctaaggcgaccaatgccgctgctgttgatcttaaaaaagtgattgaaaacaagaaaaaccagtttgaatacgacggccagccgattactaatgaacagatgaaaattatcagaaacgttttgaagtcgatgtttaagaccccgcgactttaattttaagtaaaactcggttcttttaggtgcaactgggacctgcttagtgtaaaatattgctcagttacttgaataattgctagcagcgcttgacgggtttgaatgaatggtgcacaatggcaacaattatggaacggattgggagatgggcgtatgaaaaaagttactaccgcattagcaaaaaagaatatcaaccagttgttaacgattgttaatcaaggccacgataccattgaggtggaaaatcccagcacccaagattcagcggtaatggttagtatgaaagactggttgcagattgtcagccaattagccaaaacgaatcatcatgacatggaattcagttaaataataacaaagaactaatcgtgccagtcaaggttcgcttagtccaataagctaaaggcaccaccgacataatcatgtcggtggtgcctttttgaaagtgttagttcgttgacatttgagtgctgattagtcggtctgactttcagcgtacttggttttgatataatcagctgaaacttgtaattttttcaattcttcgtctgtgagatccaattgaacttgttcgacgatcccgtcacgaccaacgacggctggatatgaaaggtatacgccgtattcttcccggaaatttgaaacggggagttcggtgagggcgtcattcaagaccgtgttggctaagcgcactgcagccgttgccacgccataactcgtatattttttgccatggaagacccggaagccaccgtcgcgtgattcggcgtctagtttggtcaaatctaaaccgcggtcagcggctaatttggtaattggttgacctaacacgcgtaccgttgaccaagctgtaaattgggaattgccgtgttcacctaggttgtagccggccacggaccgtgaatccaggtgtagtgcactggcgaccgctcgtttcattcgtgcagagtccagtagtgttcctgttccaatcacgtgattctttggcaacccggtaaccgcttggtagatcgatgtgatgacgtccacgggattagtaatgacgactagaattccgttgaaaccactggctttgattttagcagcgacgtctttgacttgtgtgctggtaaagggtaattctaggaagcggtcattagttggtgaatcttgtaacttaatattcccgatagctgagataatgacatcggcatcaatgaggctgctatagtcattgataatgatattcgtgtgataaggtaaattaggcattgcatcctgaaaatcaagcgcgtctgcttcaactttgctggtgttcgtatcgatgaggacaagatcatcggcaaagccattggcgacgatgtagtgagcggcggttgaaccgacgtgtcccattccgataatggcaattttacgtgacataatgtagcgctcctttgaaagtttatcgttcattaattaaattaccattattctcattgattttaaatagattttgtgagaaatatcgaaatcgtattcggactaagtgaaatagggtataattaacgcattaatagttgcaccaagaaagggaggagcgcgagtgtttaagcgcctaaaagattcggccttgttattttggtcacttgaaattttgattgtggcgaccttgatctgggtctgcacgaacattggttttttgtttcagccaatcggcacgtttttaagtgtcgtgttcatgccaattttgatttcaggatttttattttatatgttgaatcccttggtcaagttgttgactaaggttcattacaagaagtttcggatttctcgaaccggagctgtggctatcgtatttgtgctattattcgggttactggtgtggggagcggtttccctgttgccacggttagtcagtcaggtgacacaactgatttataacctaccaagtattgccactgagatgcaaaaagccgctactaagctgatcaataatagttcggtactgaaaagaattgatattagctcgtacaccaagcaattcaatggtgaaatcagtaagtattctcagaactttttgtcatcattatcaagtagtgttgttacggtgatttccacgattacgagtgtgacgatcatggcaattacgattccagtcgtattgttctatatgttgaaggatagtgagaaattcattccagctatcagtcggttcttaccgaagaaacagcggcctgaagtcattggtttactacaaaagatgggcgacacgatttctagttatatcagtggtcaggttattgagtgtctcttcgtggggacgtttacggcgattggctacatgttgatctcgcaaccatacgggttattgcttggcgtgattgctggattgacgaacattattccgtacgtaggaccttacattgggatcgcgccatcactcatcgtggccttcaccaagtcaccgatgcaggtagtgtacgtgattatcgtagtcgtgattgttcaacaggttgatgggaacttaatctatcccaacattattgggcggacactcaaaatccacccgttaacgatcattattttattactagcagcgggaaatattgccggaattcttggcatgattttagcgattccgttctatgctgtggtccggaccgtggttatttacctctataatattgtcgagttacgaaatgaggagcacttgcgtaagcaaacgacggtctatcagccgcaacctgctaaggcgactaaagcagacttgacgacgaccactaaatcaaaaaagtagtctgtgctataattgatgaattaagcttgaacgtggcataaggagtgattttttgaagaaagtaattacgtatgggacattcgatttgctgcataaaggccatattcggttgcttaagcgtgcacgggccttgggcgatcatttgaccgtttgcgtctcgaccgacgaattcaatgctgagaagggtaagcatgcgtacacctcgtatgaggatcgtaagtatattttgcaagccattcgctatgtcgatgaagtgttacctgagaaaagctgggatcaaaaaatccgggatgtcgttgataacgatattgatattttcgtgatgggtgacgattggcgcggcaagtttgattttctaaaagactactgcgaggtggtctatttgccccgtactgaaggcatctcatcgacgcgtatcaagcacgatttagggatgcaatccaaggattaaccactaagctagatgatttatcagtcacaaaacaccgccgttacccgcaacttcaagctgcgtaacagcggtgttttaattaacagttattagtaagtcacgcctaaatgaccatggactggttcgatgcggattatagttagcattcagccagttcaaagggcttaatggaagatggcgttgagcgccaacacgcctccgagaccgcagacagcgatgatcgtttctaacatcgtccatgtaagcagcgtttgcttgacggtcaggtcgaagtattcccggaacatccagaaaccagcgtcgttcacgtgagaagcggcgacactcccagagccgatggcaattaccatcagggcggggtcgataccagcttgcgtcattaacggcgcaactaggccggctgccgtgagggccgctacggtagcggagccgagtgagacccgtaagatgacagcgactagccagccaagaatcagtggtgagatgctgctgccactgaacaactgggccacggccttaccaacaccaccatcaattaagatctgtttgaaggcgccacccccaccgatgattagtaataacatggcaattgacttagtggcatcttcgatggtggccgtgatggccttattggtcttgtgttggtgaatccccattgaccagagggcgaataatagtgaaattaacatggcaattccgggtgccccaatcaaacgaatgatttggtcaagggtcgacgggtttttaggtgtcacaccgtgatcaacgactaattcgtagacggtggtgattgtcatcagaatcacggggaagagcgccgttaagacactgagtccaaacccgggtgcttcagatactttgaattgacgtttgttactgctaagtggcaggtgtggtttaccggtgaatgcgtcaggaaccatcttttgcgcccagcgtgaaaagagcggtcctgcgatataaacagttggaatcgcaataatgatcccgaatagtagcacatgacccacgttcgcatttagcgtcgtcgcaattgcagttggtgccgggtgcggtggtaagaatccgtgagtgacagataatgcggcgcccatgggaatccccagatagagaacgggaacttgtgcttcgatcgcaatggcaaagacgattggaatcaacaagacgatcccaacttcgaagaagagggcaatcccgatgataaatgaggcgactacgatggcaatttgtagccgtttgcgcccgaaaatatccaatagtgtcgtggaaatcgtgtaagcaccaccagcatcggctactaagcggccgagcatggcaccgaagccgaagactagtgctaactcacccagttgactgccaatcccgttctgaatactagtagcaatcttagttaatggcatccctagtccgattccgacgacgacggccgtaacaatcagtgcaatataagtattcagcttgaatttaataattaatagtaatagtagtaggatgccgagtgtaagaacaacaaatggcatagtggacactcctaacgatttagagtagcaatttcgtgatataacggtgccaattgcgccgttacgtggtcaaaaacgacttggtgttgatgatataactggtggttggcggcgttgggttgataagtttcggttgcaccaatcatggcgtgaatcgcggttaaatcatcaatatgccccagtgccttgagtccaatcacggccgctgctagacaggaactttcgaagctcgctggaatcgtaatgggttgtcccaatacgtcagtcaaaatttgccgccataaacttgaacgggcaaagccaccagtggcccgaatcgcatgaactggttcggcggctgccgtcaattgtaggacagtattcaggttcatcacgataccctctaagaccgcacgcgcaatatcggctttggtcgtggtcgtggtgacgcccagcagtgaaccgcgggcatccgcattccagagaggcgcgcgttcaccacttaagtaggggtgaaataagagtccgtgggcaccgacgggaacggttgcggcaagcgctgtcaattggtcgtatggatcttgttgattcgcacaggcggtttggctttcagtagtgaagagttcatcgcggacccaccggaagacttgaccaccgttattgattggcccaccaacaatccagtggtgcggcgcgacgtagtaacaaaatagtcggccttcaggatccaagtatggttgtttcgtcatcacccgtacagcaccggaagtgccaatcgtaatggccgcaactcctggttcatcagcccccacccccaagtttgaaagggcaccgtcacttgcacccatgataattttcgttgtgggtgcgagtcccagggttgatgctgcgactggtgtcagtccatcgatcacggcgtcggtatcgaccaatggtggtagctgcgtgcgggtgatgtgtgcatagtcgagcgcgacaggttcccaatcgaagttataaaggttgaataggccagtggcgttggccattgaataatccatttgaagttggcccgtcattttgtaaatcaagtattctttaattccgaccacgtgacaggtttgtgctagtaattccggtgaatgatgggcaagccagtgaagcttaaccaggggactcatcgggtgaatcggcgttcccgtaaggtggtataggcgatcgcccaggggttgacttttcaattcagcggcgtcttgtgcggcccggttatctgcccaagtgatgacccgggtcagcggttgtttctgactgtcaagtaggatcaagctgtgcattgcggatgaaaaggcgattccttcgatgtcttcgggatcaatgccagcacttacttgatggatggtcgcttggactgcctgccagatttcttgcgggtcctcttcggccgtggtcacagtatcatgatagagtgggtagccaacgttggcactcgcaattacgtgaccctggtggtcgtacaagacggatttggtacttgtggttcctaaatcagttccaataaggtaagtcatggtgcttcgttcctcctattcgtgatcgacagcgtggccaccaaactcgttacgcagggcggcaacaactttaccagtgaatgtgtcatcggtttctgaacggtagcgcatcatcaaggccatcgcaatgaccggggtggcgacttgttggtctagggccgtgtctaaggtccagcgaccttcaccggatgaatgcataacacccttgatgtcatctagattaccatccttgctgaatgcatcttgagctaagcccattaaccagctgcgaatgactgagccgttattccacattttggcgacggccgcgttgtcgtaagtgaactgactatgctgtaaaacgtcaaagccttcacctattgctgccatcataccatactcaattccgttgtggaccatcttcaggtaatgaccactgccaacagggccggtgtacaaatacccatcgggagcggcaatcgctttaaatagtggttcgacgacttggaaagtggcggggtcgccaccaatcataaaattgccgtcgtggcgtgcaccagcttgaccgcccgacgttccgacatctaagaagttgatgtggtgacttgccagtaattcgccgtggcggatactatcttgatagtgcgaattaccgccatcgaggacgatgtcacctgcacttaaagtctgggctaactgttcgataacgctgttggttgccttaccagcgggtaccatgatccacacgatccgtggtgttggcaactggtcaagcaaattggtgagatccgtggccgtcgccaacccgtgagcactggcggtactaagattagtggggttaagatccattcccactggcgtgtgcccgttatcctgcatgttcaacgctaagttcattcccattttacctaagccaatcaatcctaatttcatgatgaaacccctcttttatatgaaaaatattaagtgctttttgtattcgcttacattgtaataaaactatttacataaatcaaccgtatatttgtaaattattttcatcagactgaaaataatggcaaccaagcccggttttacaggcctgattgccaagaaaaaatttgttaaattgctgaccaaacggctgcgccgatacttgggaagagggtcacgagttgttcacgttgcgccggtgtcaattgatattggatcgctggtagcaacgtgttaatggtattttcggcctgttcaccgagttcagcggcaccaatcaaccggtgctggtcatccgtcacgagtaagttatggccggtgacatcgcgcgttgtctgccggaaccagtcatcctttaaatcattgacggtaactttgacatcatgagtgtcactggttggaagtgtaccaacttgggccaatcgtggggacgtgaagacgaccgatggaatggccggatacttgatgggggcattggtgtcacccgtgaataggtgggtcaggtattgcgactcaaagatagcagtgggtgttaattttggttgatccttggcgagaacgtcaccggatgcgtagatgccagcgacactcgtttgcaagtggtcatcgacggtgattcccgctgctgtgtagtccacaccgattttttcaagtcctaagtttgcggtgtttggctggcggcccgtcgcatctaagatccagtccgttgtaaccttgtcatccgcactgaggacttcgaagtggtcaccagtcgacttgatcgcagttggcacccattcacgttttaggactaaaccttgttccacgagaatggccaataatcgttcaacgaatggttggtggaattgacgaagcgcttgatcaccacgcatgagtagggtgacctgactgccggctgttagtgccatgttggcgaattcgagtccgatgtagccggcaccaatcacggtgatgtggtgtggcaaagtggttagattcaaaaagtcgttactgtcatgggcgagttcggttccgggaatgtccaaacgatgtggatgctgacctgttgcgatgacaattttatcggcggtgtacgtcttgtccgccacctgaatcgtatggtcgtcgacgaacgttccgcggccattgatgagggtcacgccggcactagtcattaagccagcaatcatatctggtaagccggcgatgacgtcgcgttcgtggtcgaagttggcttgccaatcaatcgtcggttcaccacgcagaccgtatccttggaagttagcaacttgattttttaatgctaccggctggtctaaggtgattttagcgttgcaaccccgattaggacaggtaccaccaatcaaatcagcttcaatgacggctacttttttgccacgagccgctaacggaatggccccgtcaaacgttccgtgaccgctacctagatatacaacgtcaaatttttctgacatattaaaatcctcctcgttcccaaatcacagttatttaaaaacaaatacattgtacacaacttaatttaacatgccaaataaaacgcggccttaatttaaaagtatggccctgaaatcgattgcaactggtctgtcatgactttgttaagtgaattcccaccgaatcggtgcaagatagtcggtggtactggattttttggtcaaatatcagtaaaatatgtaaggctatgtttttttacggtgggacggtaccaccgtgcacgttgaatatacaggttatgatgaaaggaatttttaatgaataagacagaattaaccgccgcggtcaatacccggcgtacctttgcgattatttctcacccggatgccgggaaaaccaccattacggaacaaatgttattgtttggtggcgttgttcgtcaggccggaacggttaaagcccgtaaaagtgggaactttgccaagtctgactggatggaaattgaaaagaagcggggaatctcagtaacgagttccgtgatgcaattcgattacgatggcaaacggatcaacatcttggacacgcccggacatgaggatttctcggaagacacttatcggactttgatggcggtcgattccgctgtcatggtcattgactcggctaaggggatcgaaccacaaacgaagaagttattccaaatttgtaagatgcggggcattccgatctttacgttcatgaacaagttggaccgtgatggtcgcgaaccattggacttgttgaacgaagtcgaagaagtcctcggaatcgaaacttatccaatgaactggccaatgggtatgggtaagggcttaaagggcttatacgatcgttacaatcaccgtgtggaactttatcataatgaagctcatggcgaaacgttcttaccactagacgagaacggtgagcttgatcctagtaatgaattgaccaaggacagtatttatcgtgacacgttggatgaagtcgaattgatcaacgaagctggtaatgattttgacgaagctaaagtaatggcgggagacatgacgccagtattttttgggtccgccctcaccaatttcggggtcgaaacgttcttgaagacgtatctgcagtatgcgcctaaacccgctgctcataagactcgtgatgaccaagtcgttcagccaaccgacgatgaatttgccggttttgtgttcaagatccaagccaacatgaacccgaaccatcgtgaccggatcgcctttgtccgcatttgttctggtgaatttgaccgggggatggacgtggtcttgcagcggactggtaagaagatgcgcttaaacaactctacgcaattcatggccgatacccgtgaaacggtggaaactgccgttgctggcgatatcgtcggcctctacgacacaggtaacttccaaattggagatacgatttatgctggcaaaaatgcggttcaattcgaaaagttaccgcaatttacgccggagctcttcatgcgcgttacagccaagaacgtcatgaaacagaagtctttccataaaggtattgaacaactggttcaagaaggtgccgttcagttgtacacttcatattcaacgggtgactatattctcggtgcagtcggtcaacttcaatttgaagtcttcaaattccggatgcaaaatgaatataattcggaagttgtcatggaaccaatgggtagcaagactgcccgctggatcgatcccgaacaattggatgaaaagatgtctagttcgcggaatctattggtcaaggaccgctacggggcaccgctcttcttattcgaaaatgcttttgccgaacgctggtttgcggataagtatccggatgtcaagctgacctcgaagctctaggatttatattgtggtttacacttagctgaccaatctagttagattactgttcgtcagtcgatgtgcgtcctatttcgacctccggggctgggtgactattgctggaacgtaagccgacatcaatttgagctaacgcacaatccacggccacttaacttggtgcaattggtcgctaactattttgatactggaactttgaataaaacatcagggtgcataaacgactttgtcgcacattcaattttgaccacagcggcttaagatagtgagctattccaatatcattttcagtctgatagttgcttagcaaaattaccgtttatgaaaggcaacgacaaattcatcaaaagttaggtacatcttcgtctgctattcgaatactatcccgactggaaggcgtttctgccaatgctcagcggtgaaattccacttagcaagcgtctttggcttggttagtggaagaccagtatttaagacgtggtcttcggcttaaatctgtgtccaccgcgttccagcaattggcagaaatgcctggaagtcggtgtaggacgcacctaccaaaaaagtttacgctaactcgaacttttcccagtgggcctaagctggctgctcttgatttaacggatagaaaaattacaacgtgtctcaagcaaaagcacgaacaaatatgcgaataattcataaaatgatggggctgccaagttgatttggcggtgccatcattttttgtgtggcaggaccggatagaagtgatatgagaggttcttctaacatgcttatcggtccatgtaaattcaccatgtaaaccaacgttgtagcactgctaaggtgagagaattacgatacaatcaacctgcaatttagattgtagggggcgatgagattgaaaataaagggacgctggatgctgggattgatgttaggaatggggttgtggggcccggtgacggtgcacgcggcgacgaacttggtacggtggccagcggtgcaaagcttagcgccccggaattgtgaacttgaatcgaaacaaacgcgcttatatcaattaaatcgtgcaacgatgcaattaacgccacgtgggacggcccggacgactagtcactggcaacgggttggtcaggtgatggtgacacaaaacaagcggttagtgacttattggcaggtgcgtcacgggactgctgggcgactgagttgggcgttggcggacaccgtacgggttgtcggaaccagggtcactgatattaagacgcccacgcggcaaccgatgcgcgtagtgacaacggatcaacaggaacacggggtgacgcgcgcggccaataagctgagttatttgcccttaaaaggggcgggacggtacaccactgagcatattttgtttcgtcctaccgccgcgtatctagcgactcaagggctacaaaatcagccagacacgttgcgccagagtagtggctatcgcgaccattatcatttcaaaacagcactgtatttaccgcaacagttagggagccgcttgttgaatgacccacagagtgcgacgttttcagctgacaatcggtacttgtacgtcatgtacgtcaatgatcaacagttgggtggcgccgaccagactggctgggtcgttcgctatgattggcaacgcctgatggctttaggggctgggcaatcagggaagatggcgatggtccgagtagcagcagctcaccaattcgacgggaagatgacggcttttgaccgtcgggtgctggccgccattgaagtggggccggagtttacggcgggacacgttcagtcactagctttaaatcctaagacgaacgagctgtggtttatttcatcgacggcacgtgatcagcttgcaagtgttgcgcgactaaatccgcaatccctgacgccggatcttaaaattgcctttactactggtagcgggcgtctaggtgatgaactgacttttgatcgcgctgggcaggcctattattggacgcatgcgagtcagctcagaaatggcaatgtcacgctttatcgtggcacaatcagttcgacgactggtgtacattttgaacaactcgcgcaggggttagctaataatccgggtttcttcgctcaatcgattggatataacgaggttactggtcggctctacctggtctccgatgagagtattacgtcacttccagcggctaaactgggacacttgacgactagtcaggtcggtgaggcgaactttgctggtgatcgcgagtttgaagggttagtcttcatgcaccacagccaggaaggtttcttgctgacgaatcggggcatcgagttgatgcgcataattgttgataagtagatattaaaatgcgccactcgctggattagattgaatctagtgagtggcgcattttagcatgattcgcgttaatcgaacaaaagtcttgtttaagcaaacggtggatctaatttcgttaaataacggcccggcaagtaaccttgatcttgcaggcgataccagacgaccccgttgtcgtcggccattcgctcaatcaaattgaccgtgtcaccatgagtgacggtggttaaatagcggccatatggttcgatgtatgtgtggacctgtttgccagggacaaaactgacgacgccggtttggcgaacaggccgtttattttggacgcggtagccggctggcaacttgagtaacagtgtgtcaccggtagttaattggaggtgcgtctccggaatccactgatcatcgccaatcgcataccaggtctcgtgagtgactaagcgaacgcgcatgtacgttttataagtgctaccgggctggagcttagttaaatagttggtcgtagttgccccaggatacggataaacggcggtcaacttgttgacttggacaaaaccagtactgaggtcagtttgttgccaattttgattgcggtagaaaaaaaggaccgtcttggaagtggtcgtgtattccccagtcacgtcgcctacggaacggaggagcttaaaaccggcgacggtcggcgcactgacttcgtaaggggttcctaatttcccccggtacatggtcggccggccaattagttcgcggcggtcaatgtcataggcgtacatccagactggttggccagcttggcgttcgtaagtcaacgtgatgctagcctgtggggtcgtaaaccagcgagtcaagccttcgatatggacgaggtggtagccggtgatgctgacggctggcaagtgaatctcttcgccaatggtgccagcaatcatatcagcagcctgcagttcattgccatcctgatctaggtggtgaacgagaactaatgcttctgtttggttaactgtaggtgctgcggcagtttgtgcggcaatggaacgtggtgcctcagtagcgcttgtggcggcttccgtgctgtttagtgcctgaagcattcctttaagtcggtcaagaaacgacacgtgaccactcctttcattaataaattaattatcactagtataacgcattcacaagggttctggcacgtcttaaataaattgtaaaattcccgctttgtcagtcgtgtatactaatatttaataacagggggcgttaacggatgaatctaaaacaattacaatattttttggccgtggcagaggaaggtcagatgacagcggccgccaaacgcttgcacgtggcgcagccaccactgagctatcagattaagcaattagaacttgaactaggcgtcaccctcttcaatcgcttgcctcagggtgtgactgttactgaagctggcaagctactggtggggtatgcccaacagctcacgcagttgtcggcgactgcggagaacaaggtccgggccctggcacacggcgtgacggggaccattaatctggggacagtttcatcctcggcaggggtcatgccgaatacggcattactaaagtggttagggcaacatcccgatgttcagcttgcgattacggaaggcaatacgtatgagttgttagacgatctgcataaacggttgctagacgtggcggtgttacgaacaccgttcaacgcgcaacatctagtctgtcgttactttcccgcagaacggatggcagcagtcattccgaagcgatattcacggtttgaaaagcggcgccagttacaactaagtgacctcgctacgttaccattgatcaagtaccgtcgttttaatgaattattccacgttgcctttctggaagcgtcggttacgccgacttacatcatgacttgtgatgatgcccgcacggcgatgcactgggctaatcaccaattgggagtggccctggtgccacggtcattggctgaaacctatgacggtggtgacgtgctgattcgatcattggcggatcatcgttttcagactcaactggccctagcaacgaccccggaagccttagcgaccccattagttgccggtttgatggcacaattccagcaagcgcagtcgctagactagtttaatcagtttgatatctaaaaatttaatcgcggttaagggtggattgctgatttaatcgggttgttaccgattacactagctagaaattgaagtggtgttttcagacgcaaaataagcctaatgactgtcgtactggggatacgctaaccttcatttaataattagatatcaatcggtttaaatggtacactaacaattgaaatttaaagggtgaaggtgaaggaaatgatttattcgttagggctaatgctcggcgttggggtaattgccggaattttcggtgctattttaggtatcggtggtggcatgatcgtcacaccaatcctgacacttggtttgggattagatattaagtatgcgattggggccagtattatcgccgtgattgccacgagttcgggctctaccattgcatatttacgtgatgagatgttgaacttacgcgtcgcgatgtttcttgaaattgcgacgacggtcggggccgtcctcggggcagtgttgacgggggtgcttaatgcaacattcctgtacttcctatttggggcgctgttagttttcacgacgtataatatgattcgtaaattaatgagtaagaacggtgaattaccgtcagtcaaagatgacaagctggcgacacagttgaacttaaatggtacttattatgataaagcattgaataagcaagttgattatcaggttgaaaacgtaccgggtggtttttccatgatgttcggtgctggtttcgccagtggcttgttggggatcgggagtggcgcgttcaaagtgctagccatggatacgattatgcatatgccgcttaaaccgtcatcagcaacttctaacctgatgatgggggtgacggcggcagcgagtgcgatggtctacttctttaatgggtcaatcaaacctggaatcgcggccccattagctatcgggattatcgtcggtgccttaattggctcacgaatcatgacgcggctcaagccacgcttgattcgcatgatctttgtgcccgtaatgctctatctgggaattcaaatgattgctaaaggattcggggtgaccatctaatggataagcaaaaaacaactaaagcgcaagagatgcacgctgttgaaatgatgattgggtatattctacgaattggcgtcattgtttctgcaatcgtgatcattattgggatgctgctgatgttgattcagggcaatggcggttatgcaaatggtatggaaccccatacggtcgctgatattctagccggcattgtggcacttaaaccatatgccgtgattatgttaggtttatttctattgattttaacgccaactttgcgggttgcggtctctatctacgcctttgcagtggaaaaagatcacttatatgtttggattacgacgattgttctcatcatcttaattgttgcttcggtgattgggtattggggaaattaataatggctaaagctaaagtcgacctaattgggaccaatggaaacaggcgaattggcgtaaaactgccgtattgtcacgtcctatgctggctttaaaatacgaacataagcgtacctaacttttgaggtgaggaaaccgacattggttgttaattaacagtaggctgtagtataactgtcagatggcttaggttgtctactatggcgtggtcatgttagtgtttctactgtcttaaaagtataagaattagcggcagaggagttatccgatgagaggatcttctttgccgctattactttttatgcaagcggagtggggatttatcatacttaaaactgaatttcagtcaaagtgtttgtctagtcctaaagatcaatggcagtttatgaatacaaatgaaatccatcggaaatcttgtctagctagttctccgtttactcaagcgataaatgaacgcaatagtagctcatgaacccgagttcagtgttgattcgaatttctcggtcaaagtaattaatgtccgattgtgcccaattatgtgactatacatctgccagttggcatcggacacgcacatacagacaaacattctgttgatttgccctatttccgcggcacttagctgtgactggacggaaatactgtcatcatttgagtattgagaaagtatccgtagatattattcacaaataatgacagatttgtgaccagcgagctcaatttatcgtatttgaattattgcctaattaaccttttacttttacgatgtttatctatcaaaactatcttaccaacttgtttgatgaggtattaatccatatagtggtcgtagaaaataaagttgattgtttactgattacgaaataaataatcgtaattggataataaatgagataaattagctaaagattaaaaaacaatgaaataactgttgacaaactaatcaaaaagccatagtatacatatataagatatatcttagttgttgttgcattttgtcatatagaaaagtgaggtaagtactatgagtaaagatacagtacaaactaagaacaagaaacagaataagattacaatcacaaaggtcgaagaagttaagccacttgctatgatttgtcatcattggtagagattgagttaaaaaaggataggtaaaactacttgtcctttttttagtttggagatgttgatgtgtgcgatatgtaatttttaagccaatttttttacccttgatagatatggataatggaacagtttgtatttctaataacgagcgtacatttacattagatagcaattttggaaaatttcaaaaaatagttaatgttttagacggaaatcacagtctaaatgatatagatgaaatcatgaaagatgataatccatacgtgaatagtgtcataaaatttttaacagaaaataactttttggagttttcggatgttgatttgcgtaaaaaaatttctggcgataatcgctataaatcaaatttattatattacatgaatttctcaaatcaggagaaaaattcagtagatgttcaacaaatcatcagaaataaaacagttttgcttcttggccttggtggcgcctcactaattgctgcaacacttgctggaatggggattggagaaataattgctctagattttgacaaaattgacaagagcaatctatcgagacagtttttattcaaagagtcggatattggaggaaagaaagtaaaggttacagaaagcttcataaatggaatcaatccagaagtacaatgcaagttttacgaaaaaaaagtagaaggtgttgaagatatttctaagatcttggacacagatgatgttgatatagtagtcaatggacttgatagtccttctgtaataacttcgagatgggtaaacaatgcttgcttggagcatgaagtacctatgattcaagctggagttagtagagcagaactgttatttgaaatgtttttgcccggagaagcttgctttgactgtgttatcgcaagcagttctttgaaaagtcagtattataaaaacaatttggtggcaatttatggtagtgatagttcgatgcaaaatgtgtcatatgcgccttatataaacattctttcggggtatgttacgcattatatgtttaattattttataaatccaggttctatcagacatagcttttatcatattatcagtactaagaatttgaccaacattttgaccaaagaatatgaaaaaagaccggactgtccgacatgcaattctgataatcttgatcagttaataagcttggaaaagctaatagattagcttgggtggtatttatgaatattttgttaagtacatgtatacggacaaatttgagtattgttccaaacaataattattatatcgtcggtaaaatagcggggcagagttattaccgtgtgccaaaggaaggcatgctgatactaaaaatgacaaatcatgcagcatgtactcctcaaaagatttgtaaagatttgggaatggaaagtgaagaggtactttcattcttgaatgaaatgatggacttaggactcattatggaattagacggagcaagacagtatgatttgcagaaatacaaatcaaatacaatagttacaaaagtcgttaattttttattctgcagggtgacatttattgctgttataggttgcttggcgggtctattaatctttagtcatgattttagacatttggtagttcgaaataatgttttgatttttgagcagtatccaggaattaatttatttatagtgaccattatcagcgtattattaacttcttttcatgaactcggacactatttagctgctaagaaatatgaagtacctgtaaaatttaacttaagtactagattatatattctagtgatagaggcaaaaatgaatggtatttggagcgtttcacgggaatccagatatgtaccacttttgggcggaatgtattttgacttaataagtggactattatgtgcttttatcatagaagttgggtcatctacaattttagacgatatgtttagtacagcaattattctgattgtaacacagtttttatttcaatttgcaatattctttagaactgatttatattttattgttgttaattttctacaaattgatggtttgcaaagtagggttaaagatgtgttacgaggaagaaagacggagcgttttgcaattgcatatacaatgcttgcttttataggtaccttaacttttatggcttatttcatttttatctttttcaatagtgtccatcaggaggttcagctcttttattataatctagtgcagaatgatattattttgaagcttgatagtattatgggattaggagtcataggtttaactgcaggagttacttttttaattattttaaagaggataatgcattatatgagaagtacgcgtggtataagtaaatactgaattcaagtagtcctggattgtaatctaagcttgctatcgaaaaattcagtagaaatccagttgtgttacgatcaaattcattcttcgtgctatagaaagctcatgtcaaaacttcatatcagcttcaagcgttattttgctgtcattatgttagctgaaagcctttacaattggacgatatggcgtttgaaattggatcctatttttagctgcctctgttggtaatagctgtgcaccagatatcttcgcgttacttcataattcgatacaacctcattgaagtatcaagatacatgtgctttaaaaccacgaaaatgtactttcttagccacagtgtgaccggaaccaacgataaaaatctggtctaaatttagtacaaagcaaaatctttaactaaccagtagggacaattgaactgtaatgtgcgtaatcatgagtgataccgctttaaaacgcattagtgactggcacaagtcattgctgcggttgcggtgaagaaaaaaactatgtcccagacattagaaggcttgagcatggttagagtctacactgagatggagacacctactatctactaaggaatgataagtcccaatacgtggatgtttgtcaggccaatatcctcaacacggtgatgtttttgaaatcattatagtaagaatggtcctagtacagaagaatacaacgattaaatagatgttggaaattgaatgataatcgaagtcacatttgtgtacacatgaggtagcttgtcgacggctatgacctttctatggctttgctggtaaagtctaatctggggattattgatagttattgttttattgcgagctggtatcacacataggaggagctaatttcatgaaatatgaagattatgtagaactagggttaagagatgatgggcaaatgaaaatgatattgaagggcgatgtcttaactgagggtcatgaacgttacggtgttgtttcagttgtttttgtgactagagatgtaaacagagcaaaggccagattagaagcattgaatgagcataaaaagaaggacgattattatatggtttatagttgtcctgaagataccgatttagaattgctttcccattttccgtcaattgagattacaaaagaagatttagaaagctaattcatgaccaagctgattcgttttttcaattcagtagagatcctgtctcgttggcgagtgaagaggtagtggtagccatcaatagtatcttccgagaccgttccatgaattatgattttatcattaaaaaaaacagcttaatatggctcggtttgtctggtttatggcaagactgattcgtgtaagttatcgatgggctcacgagcatcgttctcggagcccactcgcaaacttaacatctttttttgtggcacgcgccggcttctacaaatgtctatagcgcgcatagtttctagtgacgccgaatttaactttttgaggtttaaattgacatatgtcaactccaattgcaattaataagagaatgctgataaaaaatcagcattcttttttatttgcgcacttttagctgttttgactaacgtaaaaaagacctaatatcgtcatttttatcgttatttgaattatttattaagaaaaattgccgattgtgttcacttgatagttgaacactggtgtgagaatataattgctgatatatcagtaatttcaggcgtgtttatcagtatggataataatcgcaaaatgaaataattaagacgattatgacgaaataatgataaaaattagagtttaggattgattttaatttatttataatatacaattactttaacttttcgagggaaaagcacacacaaactattttaaagttaggggttgggttatatgaatttcaaaacagctgcaaaagtaaccgtcgttgccggcgcatccgtactattcttagctgcttgtggctcaagcaagagttcttcaagttctaagcaaacggccaattggaccgaatcagccgaattaccaacgatggacatttctaagtccaccgatgtggttagttctaacgcgttgaataacaccaatgaagggttataccgtctcggtaagaacgggaaggtcacacccggaattgcgaaatccactaaggttactaatggtgggaagacatatacgttcactttacggaagaacgcaaaatggagtaacggggataaagttactgccaaagactttgtttatggttggcaacggaccgttaatccaaagactgcgtcacaatacgcatacttatattcagggattaagaacgctgacgctatcgtcaatggcaagaagcccgtttctagtttagggatcaaggctgatggcgattacaagttgacggtcactttggataagccaattgcttactttgacaagctgatgggctttgtcaacttcttcccacaaaatgaaaaagtggttaagaagtacggttctaagtatgggacgagcagtaaggccatggtttataacggcccttacaagatgactggttggactggaacaaacttgtcatggaccttgaagaagaataacgattattgggataaaaaggctgttaagatggacagcatcaagtaccaagtcgttaaggatccttcaactggcttgaacttatttaattccaataagctcgactttacgacactttccaacgaacaagttaagaattataagaatgataagaactacttagttcggaagacggcttcaactttctacgttgaatttaatcgtaaggatagcgataagactttagccaaagctttccagaacaagaagattcgtcaggccttgtcattagcaattaaccggaagtcctacgttaataatacgttaggtaacggttcgaccgtttctaaaggttacgtttctgaagacttagctaaaaacccgacaactggtaaggactttacgactgacgctgccgttccttctgcagttgactacaacttaacgaaagctaagaagttgtggaaagaaggtttgaaggaaatcggtgaaactaagttgaacatcaagttactttctgatgatacggatgctggtaagaaagccactgagttcattcaaggtggttgggagaaattacctgggttgactgttactaaccagaacgtgccattcaagacccgtcttcaacggtcacaaaacgggaacttcgatacggttatctctgcctggaatgctgactttactgacccaatctccttcttgtcactcttcacgtccgacaactcatacaacaatgggaagtatgacagtgccgcatacgacgatgctgtgaagaaggcggaaggtgccgatgccaataacaagactgcacgttgggctgacatggttgctgctgaaaagcaattgatgaatgatcaaggggtcatcccaatctatcaacaagcctcggcaacgttgactcggagtaatctgaagggcatcatctacaacactgcgggctcaaactacaacttcaagtacatgtccgtaaaataatgatgtaaatccacagaaaaaagtgtgtgtgctttaactgaatgaatgtgaagcaaaggggtaaggattgacacattgttaatccttaccattttgttttataatgagggatgtcattattttttaagttgattttaatagaatgcgaggaattctcatgagaaagtatcttttaaagcggatattttacttgttcctgacattattcattgtggcgaccgccacgttcttcttaatgaagttaatgcccggaacaccgctgcaaaatgaagctaaattgacccctagtgaaaaggcgtcgatcttggcccaatatgggttggacaaacccgtttggttgcaatacttcatttacattggcgggatcttcaaggggagcttagggctatccttccagttctctgatcaagccgtcagttacctgattggtagccggatgggaccatcaatgcagttaggtggccaagcgatggtcgtcggaatcgtctttgggattatcctaggggccgttggtgccatcaagaaggatacttgggccgaccgtttagcaaccatcttatcgatcttagggatcgcagttccaagtttcgtgttagccatcctgttacaatactacctcggcttaaaggctggttggttcccagttgctggctgggaaggcttcgcttacacgatcttaccaacgttagctttggccgccagtccgctggccgaaacggctcggtttatccgaaccgacatggtggacgtgctgagttcggattatattgagctagctaaagccaaagggttgtcgaagtttggtatcgtgtatcaccatgcgttgcggaacagtttgattccaatggttacgctgattggaccattggccgccgccttgatgacgggttcaatggttgttgaaaatatcttctcagtacctgggattggggaacaattcgttaaatcaattctggttaacgactacccaaccatcatgggtgtgacgattttctattcagcactcctttgcttactattattgttgaccgatattgtctacggaattattgatccgcggattcgtttaaatggaaatggggactagttaatggcagaaaatccaagtagtatcgatattaagcccggcgacttcgagccgttagataaacaagcgggtcctgataatgaacggatcgcagcaccttccttaacgttcggccaagatgtatggcggcgattgaagtctaacaagaccgcttttatcagctttatcgtgttagtattcttattcttagtggcatttggtggacgggcagtctaccatgttgatcctaatgcacagtcgccacggtatgcgaacctccctccgaagattccgggtgttagtatccatggcttgaatggtcacttgactcaatctggtaaggacgttgatgcgtatgcggcggccggtgcaaagtctgacgtacattatcttctcgggactgattatctgggccgggacttactggcgcggattatgtatgggacccggatctcacttgaaattgcgttgattgctactttgattgacctgacgattggggtcggattcgggatactctccggttggaaaggtgggcgcgtcgatttattcatgcaacgtgtgattgaaatcctctcgtccatcccacaattggttatcatggtgttgatggccacggccttcacgaagactgggatggcctcaatcattgcggccatcgcgatcactggttggaccacgatggcccggctgactcgggcacagaccttgcaattgaagaaccaagattttattttggctgcgcggacactgggtgaatcacccgtcaagattgcttggaaacacttgttaccaaacctttcaagtgtcattattattcaaacgatgttcacgattccaagtgcgatcttcttcgaagcgttcttgagttatatcgggattgggatcagttcaccacaagcttcattggggacgttgatctctgatgggcagaagaacttccaattcttgccatatcagatgtggtacccagccatcgtgctgatcatcttgatgctcgcctttaacttgttaggtgacgggatgcgcgatgcgtttgatccaaagtcaaaacgttaggaggacggcagcactatggaaaaaccagaaaatgtgattgaggtccgcaacttggaaatcaatttccatacttatgcgggcgaagttaaagccatccgtgacgttagctttgatttacgtaagggtgaaaccttggcaattgttggtgaatcagggtctggtaagtcagtgacgacacgttcactgatgggcctgttagcacctaatgctgaaattaaacgtgggagcattatgttccacggtgaagatattattaaaaagtccgaaaaagacatgcaacacattcgtggtaaggatattgccatgatcttccaagatccaatgacatcattggacccaacaatgcggattgggatgcagattgcggaacctttgatgaaacataagggtttgaagaaaaaagaagcgatcgcccaagcgctagagatgttgaaattggttgggattactaatcctgaaggccgaatcaatgattatccataccaattctcaggcgggatgcggcaacggattgtgattgcgattgcattggtctgctatcctgaagtcctgattgctgatgaaccaacgactgccttggacgtgacgattcaagcccagattctggacttgatgaaggatttacaaaatcgaattgatacgtcgattatctttatcacccatgacttaggtgtcgtggccggaatggctgatcgggtcgcagtgatgtatgccggtaaaatcgtggaatacgggacagtcgatgagatcttcttcaatccacaacatccttatacctgggggttactcaattcgatgccaaccttggatactgaaagtggctcattatcagcgattccagggaccccaccagatttgttggaaccaccagttggtgacgcctttgcagcgcggagcgattacgcgatgaagattgatacggagaaggaacccccattctttaaggtttctgatacccattacgcggcgacctggttactacatccagatgcccccaaggtaacgccacctgctgaaatcgttcggcgtcagcaaaagtttgcggccatgcaaaaaccgcaagcaccaatttcaaatcccgtagcaaaggagtaagtagacatgcctgatgaacgtaaaaaaattctagaagttcgccatttaaagcagtattttaatgtcggcaaaaaagatgaagtccgggccgttgatgacgtctcctttgacatttatgaaggtgaaacatttgggttagttggtgaatctggttcaggaaagaccacgaccggacgttccatcattcacttgtatgaaccaactgatggtgaaatcatttttgacggtaaggacgtttccaaattacacactaagaaggaacgccatgaatttcgccgggagatccaaatgattttccaggacccatacgcctcattgaatccacgaatgaaagtcaaggatatcgtggcggaagggattgatattcacggtttagccaaggatgatgcagaccgaaccaagcaagttgaagacttattggagacggttggtcttaacaaggaccactctagtcgttatccacatgaattttcaggtggtcaacgtcaacggatcgggattgcccgggcgttagcggtagagcctaaattcatcattgctgatgaaccaatttctgcgctggacgtttcgattcaagcccaagtggttaacttgatgaaggaattacaagttaagcagaacttgacttatttatttattgcgcatgatttgtcaatggttaagtatatcagtgaccggatcggcgttatgcattacggtaagattctggaaattgggcctgcggatgaagtgtataatcatccgttacacaagtacaccgagagtttgatctcggcggtgccggtacctgatccagagtttgaacgtaaccgtaagcaggttccttatgacgaaacgaccgaacatgacggtaagaagcggcgaatggtcgaaattgcaccagggcactttgtccgggcaactgaagacgaaatcccgatatacaccaagcgggctgttgacgcggggttaattacggaattttctgagtaacggctaataaaacagacggcgagtgcgaatactcgacgtctgttttattattcagtagaatatttaattaactgtttagataagtttattaattaataaccattataattaactcatgttaacttgacatataaatttaatatgtaaaaaatattgatggaatcaattgtcaaaaatccgattaaatcgggaatagatggctatttttgaccagctaaactgtgaccggtagtcaaagttatttgtgtaaattttgtaattatgcaataataatattgttaataaagtttgttaacaaatataactattcgtcttaataattgattcgcaccatcccgactggaaggcgtttttgacaatgcccagtggtgaaagttcacttagcaagcgttctgtgcttggttagtgaaagaccagtatttgagacgtggtttttcggctcaaatctgtgcccaccacgttccggcaattggcagaaatgcctggaggtcgatgtaggacgaaccaatctaagcatatttacgctaacttgaacttttcccagtgggtctaagctggctgcttttgaacttaagaatcggcacgttttaatcatgattgtttaataacgatgagtaataaaaaaacaatcgcaccaattctagtagaatcggtgcgattgtcttaacttacttatttattgagctgcacactgttcacaaagtggcattaaatctttcaaatcctcgacggatgagccattttctaagaagcaattgaccatatctagccaatattcatcatcggcgctaaaatgcgcgttgacatctttgcaaggtaataacccggcattggtataggcgacgattttatcagcagcgaccccgctatgggctgctaattgttccagagtcattttctctcaccatttgtcctttcaaaaaatcaatgtgattatgttacgcccccagcttttgaaatgcaagcaacaatttcgtaacgtcacgattaaaaatcaatgataattttcttcattattttcaccgaaagtagtaaactaactcttaacccgcctttgcctcattcgtcaccctactattggcggatatcaagcgtgctttttcatcataacacgcactcaaacttaacctacatagttatcctgtttcatgaaccacactaattgtcagatagtcccatttagtgttggttaacgcatacttattgaatcggaggtcgtacatttatggattctagtttaacctttcgcgcgggcatcaaagatgtcattcccaccgtctttggatacattggcgttggcctagcaatgggcattgtcgccaacacgagtcacctatcagtttgggccgttctactcatgtcactaatcgtctatgctggttccgcacaatttattatcgtcagtatgctcctagcaggtagtccgatttcggcaatcgtcttatccacttttttgattaattcacgcatgattttaatgagcatgtcagtcgctcaatatttcaaaaaagagtcgttattgcaaaatatcggactgggatcgttactaactgatgagaccttcgcgctcagcatgaacaagctcaatcagaccaatcaacaattaaaaacgagttggttacacgctgctaacattgtggcttacttagtttgggcagccgcgacagtggtggggtgccttttaggtaacttgattactgaccctaaccagttcggcttggatttcgccgttgttggtatgttcattggtttactttacttgcagatcatcacggatcgcagtaaatcattgccgacccagttgtgggtcgtactatttgtggccctcgccatgtattttctcatgcgttgggttccgggcaacttggctttgatctttgcgacgctactcggttgcggttttggaatggtggtggaccacaaatgagtacttacatttttgtgaccatcttactctgcggcctcgtgacttggctatcacgcattgtcccgtttgccatcattaaaaatctgtcagtcccccaatggctaatcagctttttatcatttgtgccaattgccattatgaccgctatttttgttgaaagtctgctcacctaccatgcgggacactggccagaatttaatctcccaaatatttatgcctcaattcctgccattcttgcaggagtgctcaccaaaagtttactagccgtcgttataacaggcatcgttgccatggccgtattgcgcctagttggctgggcttagagcgcaagggcacatctaatttaatattcccacttaaacgtcccgcaaatttgtgcatgagtttgcgggatttttctgtgactttttcagccataaggccggcaatcagcatctaaatgtgtcatgtcaataacggtcaattcgaactaaccaaatagtcagtagaaatccgctccgccaaggacccggcatctaactgattggacgtttcgcgcaatatgaaatttttatcaatgaaagcgttccatctgcgcgctccgctttatcttatgaattaaagcaagtataatagtcaaagtgtacgtcgcggattgtcaagcataattatgacagacattggtaagaaaccgttataattgttcagagtgctttacatccgtgaatgaaacgggtaaattaacaacgaaccatctgtacacatatagtagataagaactgtctaaactttaaagattgagagatgaacagacatgtgcggttttgctggttgcttaactgatcggactaaagcggataacgcagcttacgatcagaccatccacgaaatgactaaaatgattgtccatcggggacccgatgatgacggttattttgctgatgacaacattaccatgggttttcggcgcttaagtatcattgacttagccggtggtcaccaaccactatcttatgataatgaacgttactggatgacatttaacggggaaatttataactacgttgaattacgtgaacaactcaaacaagaaggctatgaattcaaaacaagctccgattctgaagtaattcttgcgatgtacgccaagtaccacgctgacgcaacgaagtacttacggggaatgtttgctttcgtcatctgggataaacaagaaaaaacgttatttgccgcgcgcgatcagttcgggatcaagccgttctattacgctatcagtggtgatgacttctattatgcttctgaaagcaaggccatttacaagattttaaaggataaaaccttcgataaaaatgccttacaagattacatgacgttccaatttgttcctgaaccagaaacactcacaaaagaaatcaaaatgctcgcccctggttgctccttgacgaaaaagttggggtctgcaccacggattgatcggtattatcaccgtgaattccatccggtccaacgttctgaagacgagtatgcccaaaaaatcaaagatgccttaattgactccgttaagattcacatgcgttccgatgtaccagttggttctttcctttcaggcgggatcgactcatcaatcatcgtcgcgattgcaaaaaacttcaacccgaaccttgaaacgatctccgttggtttcgaacgtgaagggtatagtgaacttgacgttgctcaagagactgctgaaaagcttggtgttaagaattacagcatgacgattacgcctgaagccttcatgaaggccttcccgcactttgtgtggagcatggatgatccgttggctgacccggccgctgtgccgcagtatttcttagccaaagaagcggtcaaacacgttaaggtttgtttgactggtgaaggcgctgacgaactcttcggtggctacaccatctatcatgaaccagaatcattgaaaccgttccgctacacgaaaccgattaatggtgccttgaagcgtatcgcactcatgatgccagagggaatgcgtggtcggtcattcttactacgagggaccaccccattagagaatcgctacgttgggaacgcctttatctttggtgaacaagaaaaacaagccttcttcaagaattacaatcagaaccatccgttccagtccatcacgcaaccgctctatgatgaatccgtcgactatgatccaatcagtcggatgcaattcatcgatatgcacacgtggttaaacggtgacctgttgcataacgccgaccggacaacgatggcacacagtttggaactgcggaccccatttgttgaccgtgaagtgtataacttagcagccgaaattccagctgatcttcgaattagtcacggcacaacaaagtacattcttcgtaaagcggtcgaagacatcgtgccagcgcacgtccttcaccgtaaaaagcttggtttcccagtaccaattcggttctggctcaaagatgaaatgtacgactgggctaagcagatcattaacgattcgcaaactgaccaatacttcaataaggactacttcttgaaactcttagatgaccacaaggccggcgttcgggataattctcggaaactctggacggtcctcaccttcatgatgtggcaccgactctatgtcgaatctgaccacttgatggatagccccgaagctaacgctgttgcggaaaaagtcgaggagttttagatcaatggaaattattgttcaaaagttcggcggcacgtcagtcaaggacgaagccgcccgtattcaagctttaaagcacgttcaatacgccgtcgatcagggcgataaagtcattgtcgttgtctcagcaattggccggaaaggtgccccttacgccaccgactcattactcggattagttggggccgagcactcccgcttaaccaatcgagaactcgacatgttggtctcagttggggaaaccatctcgaccgctgtctttaccgagttagcgcgtaagcaaggcctaaacgtcacggccatgactggtcatgatgctggcatcgtgactaacgacgattttcaaaatgcgaagattctccgcgttgatccgaaaccaatcacggacgcctttattgacgccgacgtggtagtcgtaactggttttcaaggtgctactgagagcggccacattactacgattggccgtggtggttccgatacatcagcagccatcctcggcgccgctttaaaagcaaaacgtgttgatatttttactgatgtcaacggcatgatgactgccgatccacgactcgtcacccacgcccgcttcattaaggccatcagctacgaagaacttgctaacatggcccatgaaggtgctaaggtcattcatccgcgtgctgttgaaattgcagaacaagctcacgtgccgatgcggattcggtcaacttatcaggaacccgacgaattagggactttagtcactgaccggaccacgacccaaatcgaacattatcgtaccgtgacagggattgcacaccaaactgatttgacgcaatttactgttcctaccgatacgttaagttcaagtgccattttccaattgatggcacagcacggtttgagtgttgactttattaacattacaccacaccaagttgtcttcaacctggttgatggtgacgcggacgttgccaagcagctactgactgacgcgcacgtccattgtcagtcaattgcgaactgtgctaaagtttccgttgtcggtgctggtatcactgggacacccggcgtcactgctcggatcgtctcggcattagctgcacaacatatcgatattttacaatcgaccgatagttatacgaccatctgggtgctcgttaaggaagccgatttaaaagcggccatgaacgccttacatgatgagttcttaggaatcgaataaccatccctgcaagtccggcttaattgccgggcttttttgttgacctagattggcctggagatggcacgttcaaccagcagcacaccatgtaccgagcgattacaagcataatttcaattctcatttggggtgacaattatccggtttgcatgtattctagaaacagtaactttattgaaaaggacgctaatattatgcaagcaagtcaattaattaatagtttaaaattcaagcaggttcagcccgccttgaccacggactttgatgtcaccatgctgacgcaggatacccgcgaagttcagcccggcgccatgtttattgccgtcgttggttatcacgtcgacggtcacgacctcgttgatcaggccatcggaaaaggggccaagatcatcgtggcgtcaaaacctttagacgtcaacgtaccggtcatctacgttgaaaacaccgaacgcgctatggcaattcttgccgacgttttctacggtgcgcctagtcaaaagatgcggatgattggggtgacgggtaccaatggtaagaccactgtcacccacctgatcgaacaaatctatcgtgatcagcagcaagccaccggcctgattgggaccatgtatcgcaaaatcaaggatgaaaaactgccaactgccaacaccacccccgacgccatcacaacgcaacggactctagcggccatgcgggatgccggtgttgaaactgtcgccatggaagtttcttcaattgccctcgtactcggacgggtctgggggattgattacgacatcgccgttttcacgaacttgacgcaagaccatttggatttccacaaaacaatggctaagtacacggaagccaaggccatgctctttgcacaactgggcaataagtacagcgccgacggaactaataaggtcgctgttctgaacaccgatgatcccgttggccgtgaatttgaacagtacacggcagcgcacgtactaacatttggactcaaaccagatgccatgatcaacgcacaaaatgttgaaatcaagagccacgggactgaatttgacctctccgtcttcggccacgtaacccacgtgacgatgcaactgattggccagttcaacgtgtacaacatgctggcggccttcgccgcagcttacgctagtggcatccccgaagaccaaatcattaagtcactggagaaggttaccggcgttaagggccgcttccaatccgttccttcccacacgggtgtcagtgtcatcgttgactactcacacactccggacggcttattgaatgccctagaaacgattcaagatttcgcgactaaggatatttattgcgtcgtcggctgtggtggtgatcgcgacaagacgaaacggccaaagatggctaaaattgctgtcgaacacagtactaagccaatctttacttctgacaatcctcggacggaagacccaaccatgattctaaatgacatggttgccggcgtgccaaacgccgacgtgcccgtctacgaagaccgccacgttgccatcgccaaggccattgaagcagcacaacccggcgacgttgttttaatcgctggtaaaggccacgaagattatcaaatcatcggccggactaagcatcactttgatgacagtgaagaagccgctaaagcactagctctgaaaccaaccattgattaatggtcaaaacagaactgaccgacaaggctattttcaattctatttctgttaacaattggtgacatccgtgacacgcgtctttaaccattaacacccccagcaacagctaatttgattggccgttgctgggggtgttttttgcttgtttggctttctcccaaccagcgctacaaaacaggcatcagtcgtgtttgtacaaaagatgcacccacctttcgattattaaccagccaaactatcgcctatctttgataattcacctaattcggaaatataattatgttgataaaaggggttaattatcattgttagtttaagtttaattcgtttggggggatttataatgtcaatttttcaaacttggaaacgccgaattgcatacggttccactgacatggccggtaatattatttggcaaatggtcagcacttacttactgttctattacacaacggtcgcgggcatctcagctgcttttgcaggaatgctgttcttcgtcgtgcgcttcattgatgcgtttgatgcattgatttatggttatttgattgatcatacacacacgaagtatggacaatcgcgcccctactttgtgtggtttggcattccgttagggttgctggccatgtcgctattcatgattccatcatttggcggcaataccacaatgcgactcgtctacatttcaatcacttacactttctttagcctgatttattctggtgccaacacgcccattacttcgattttaccaagcttgactgatgatagcgttgagcggaccaagttagcgagtgctcggatggtcatgacaaccattgggaccagtgcagtggcggccatcactttgccaatggttaaattactcggcaaaggcaatcagtcgaaaggtttcaccctctgggctattatcttaggcctcgttatcatgggactcttcatctttgcttttctcaatctcaaggaaactaacggtgcacaaaatccagacggtaccactgagtcagccgaatcactctcaatctggcaaagcttgaagggtgcggctagcaacaaaccatggctattattagcctgctcattcattctgctacaaaccttctggatgctacggggaaattcagcgatcttctttatcaaatacgtctacggtcggcctgaattagcgccaattttcctggggattggctttgtttccgtcatcgggaacctgtccgtaccattcctatcacaacgctttaagaaccgtaacgttttgcagttttcactcgtactgggcgttatcggccaactactgctgccaatcgctgaaaagatgcgtagtgtgagcctactaattgctggctccgtcattttcttgattgcgatggggatcacgttcacgattgtcttcgcgatgctatcagataccgttgactactcaacgaaagtactgggcctaaatgaaaccggattcctatctgccgtaccaatgattggcgccaaattaggaatgggaattggcggttttctagccggtcaatttctcgcatggggacaattcaatgccaaggcagctgtacagtccggacgaaccattacatttattaatctcgcttttatttggatgccgattattttattagccgcgatgatttccatgatgcaattctatcggttagacgaaaaagaattacaagccaacaaggccgacgcagcggctaaagttgaacctaaggaggatgttgaatatgatgccaacaattaattcgattcaaacaaccgtcaacggcgtcgtcaaaatcgttaaaccatttaacaacgacatcgccgctgaacaatttgacccgcacgtccttcaaacactaacggccttcaaacaaccagccatccttgaaaatgatctagcggcgctccgcagtggtagtttaacccccgccatcgcggaccctgttggtgatgctgttacagttcaaagtcgaaatattacggctctgaatcgcacggtcagcgttgaatggctgacaccacaaaatgtcattaatcacacagtactggtctacttccacggtggtgccttttacggcggtgttcccggcaataatacggtccttttaaagctggtcgcagctaaaagtcactgcgagattcttaatgtcgattacagcttagcgccagaagcaccagcacccgctggtattttagacgggctcgcgattttccaatatttggaacaacgtgacgctgaaacaatgattaccgttgctggcgattcggctggcgctaacgtcatcatggctgcaacaaatctgaatcaacaactcggtagcaatcgtatcaatcaacaactgctgttgtacccagttaccgccccaaatgctgaccacgccggtccactctgggatttggccgcctttccgattattgactcacagcgtgccattctcaccaactatcacgacctctttcggcaacttgacagcatcatgacggattattatgttccagagaactttgattcacattctccactcatctcaccgctacaccaggaaaacttcacaatgacaccaccaaccacgatcatggtcggcgagtttgatcccttccgaccacaagcttgggcttatgcacaacgcctggccgctgccgatactgcgactacgtttattcagtatcagggcttgaaccacgctttcgcaccattagtggatcagtattggcaaagccaagatgtggcccaagtgatggcggccgcgttaatttagcgactagggcatatcaaaaatcaccagtatcacgttgcagaaatcacatgtaaaaaacaagcggactgataaaaaccgccccgcattttactatccgaaatgcgggcggtttcgcgttaagctaacatttaagtctgagacttgtgctatactcttggcatggggggattaacgtgaacaaaaatgataaagccaagcgtttgatgcaacaaatcgacgttgcctataatgatcctgaagttaaacaagacgcacaagttcgtgctgacttacttcgctatgctatggaacttgacaagaacggtaactatttattaattgccactaaagttaacggcatggcaatgcgcgtcatgcgtgatcacatgcaccaaccactccaagcaattaacacactctacacccaaaccgcccgcacctccgaatattattggggcgtggcggcagctagtatttttagtgggctgtggtaaagcactatcacgtgcgagcgctcactataaatcatattaacaacagttttgaaccggaacacagacaaataacttgaatcaaccgttaatttcaaagggacgctcctgacaaaccatgccagaagcgtccctttactaactacttaaaattttatcgatcagagtcaagttaacagctaaagtaaggcgttgtacttggctcagccatttacttcaagtacccggtttcattccaagtcgtcagttcaaaatgctgattatccgtcgtcgataacactgtcaggctatcattatccacgataccgtggcccactgtcttcataacttgcccatcgaccacaaaaggtgctcgtaattctgctacggggacacccattaacgccttgacagtcatcgtagtcaccaggccgtgcgatacgattaatagtggttgcgtgctagctaccccaacttgatcaatcaaacgatgtagcgtcgaagtcgttcgggtgacaaaatccgcataactttcgccaccgccagctagttccggtcggtattcggcgggtttagtaaaaataacttgggcgtaggactgcggctgtacttccgcttcctgtttgccgtcccaatcaccaaaatcaaactcacgcaagccatcgtcgatttgaatcggcggttgccactgattggcagccacaatgtatttcgccgtatccagcgctcgttgctgcggactgctatatactgctgaaaattgggtggtgcttaagtaatcaccagcggcttttgccccatcgattccgctagcaaccagcggggaatctgctcgtccaccttgaaatcggtgttctaagttatattgtgttcgaccgtgacgaatgaaataaatctgcatggcacgttcaccttcctaatccgttcaatagtttaattctaactgtgtcatgctcaatagaaaagtcttcagtgccataatgacgtaaaaaaataccgtggtctaagaaacacaccacgatatttcagttattatgataaaggcttaaccaagtgctggtacggatgtgtgccaatcatgagctgaccatccgggacaaaaccatgccggtggtataacttagctgcccggggattgccatcatcaacgtttaaactcagtttcgtggcccccagttgaccaactagtcctggtaatgcttctagtaaggcactaccaactccgtggccctgagcttgcggatcaactgccaacatgcttaaataccactcattcggccgggtctcaccacctaattccagtggtgcctcaaaccccgcatgatgacctgaagtcgtccgcaacaaatcgtttacagcgacttcattcttcgctaagtgcccaaacgcgacaccgacgattttgtgagccatgaccgccacaaaagtctgcgctaacccatctaaattggccggtcgctgatacaactcagtcaacattgccaataggtcggcctcgctaacattttttaagactggcatttccatatcacggtaaatcatcgcaatcaatggtgcaatttgagcactatcttgcggttgtgccgttcgaatttccatcatcacaacgctcccaactgttttctcaaccgtagcaaatcccgcggtcatcgtcaatcgttgtgcttaatttgttgccgatgttgaatcgtcatcacccacgtcgtgacgggaactaccaggataacgccaattaacgagaataataccattaatacttccgcaacaaatattttattattgataacactcccgaaggaataatgtaagcccgcaaaccagataaatagcgccaagaaaccaccaaaaaagccgaaaaacaaggtattaaaagtcgtcccgataatctgcttaccaatactgataccatcgatatagagtcgcttagttggcaactgcggatgctgcgccagaatttcactcagaccagccgcaatcgcaatagcagcttccgcaatggcccctagtgtacttaaaattgcttcagttactgctacgccaataaaggagaccccaatggctaacgacataccttccagatcttcactatcttctaaactaaagccctgcgccatgatccaattttcaacgggaaaaataatcagcactaaaatgaccataacaatcaatgctgcaatataagctggcttggccgccacttcgttgtcctccccaaagaaaatcgtgaaggccaagatgattgtcccaatgaccaacgacacccccattgctggaaagccccatgaaatcaaaacaacggctaaaaacaacaatccaaagttaaataacaaactcaaaaaggccgtcgctccagtcttaccaccaattaatgtcatcaatcctagtaagatcaatcctaaaacggtaatcgtgttcatgccatcaccgccttaggcatcaatcgactggctaaccaactggctactggaatcgctaaaacgataccgataccagaaatcaaactttggaccatccccaacgacatattcattgtaaaagtgtaaccccagctattgccgttacggaaatagagcaaagtcatcgcgaaagtatccgccatgaaaatcaaaaatagcacgttgatcaagggtcccataatagaccggccaatttgaatacccgacttaaatacttgtcgtggtgcaatgtccgggcgctccgttttcaattgaaacaatgaagcaacaatatctgttgattcatccatgactgctccgagtgaaccgaggactgtttcgactaaaaataacggtcggggaacctgcgtcacgtactgcatcgattcataagtcacaccacgctcatgggtcaccgcaaagacgatcagactaataatgacagccagtcccgtgccaaccacagtcgcacccaatgttactaacatttgacgactaaaaccgagaactagcaacagtgtgagcacggcgaagattacggccaatacgccaaagagcaggtaaatgtgaccaccattagtagctaaatcgatctgaatggcggcataaaatagtacagcgttgagcgcgacactcaaaaaggccatcagaccgctgaaacgcataattaacaagagcagtgctagggctaaccacgcgacaaacgccaatgcggtatctcgttttaacccctgaatcgtcactgcactactatgatcgctaggaatccgtaagaagacttgattacggacgtgatacggctgatccattgcgcctgagcgcgtatacgtattcttgatctggtaagttcgaccacgatgtgccttattgagcacccggaccgttaccaactgtgtcactgtcgcatccttattctcaaattcatccgtcgtcgtgcttcgactcttagtctgcacgtgggtcacttgtgcaactgtctgctgataaagtcccgcattaactcgggtcaatccaaccccgattagtcctaaaataatcaccagcagtgttaaccacaacccccaccgttgcttgattcgctgtttcacattttcaccttttttcacttcaatggtcaccagtttaccacccattttccaatacaaacttcgattctggcaatctttaacagaatctaagtttctacggtaatctaggccgttacttgaacgcgtaaagctttcagccaagcaatttcttcctcatcgtggaggcgctgagcaatttttagtcccttttcaatcaatgccagggcctgttcaggttgctgatggacccgccattcataaacggcagttaacttataatgagccaaaggttggtaacgacgtaataactgttgaacaccatcatcttgataccaggctatgatctgggggtcacgatgattggtgaccaagttccagtacaatgtcgcatctaaatacttcgccaaatcagctggcggcaacgtattgaaacttggctccaagcgactcaaccccgctaacagttcgggggtgtccagcccatgttgaagtccccattccagaatcaaccaggcttgccggacgactaaataattccgattgccaccatcgcgcggcataacaatcatactcgcatcaaggtcacggacactaccggtctgaaccttaacggccgcagcacacgcagtgacatacgcggcggtcatcgccgccgttgattcgcgtgcctgccgaaattcctggcccgccgtgggataaccgtgcaagttcattggtaataattgggcggctttcaacgtattgacccagatccaaataatgaacgcaaacaaccataaatcgaaactaaacttaaattgattcagagttattaaactgagcatgaccgtcagtaagttgaacaggccaccgccaaaacaataaatggcgtgattgaaccgtttggcatccgccgggggtgctgccacgatatgtggatgacgcgtcagcggtcgttctaatttccaatgaccacgaacccgacttaattgaagtcgaaaaccggtaatccggacaattcgagcaccaattaatcgaaatccgacccactgaccgagccaatggattaacgtcgcacctagttcgctggcgactagtgccaatcctagccaaccgactgttgcaataaattgtccaaaaacttgcatgctattcctcctcgtaccttgattgacagcctttatttaacaaaattaattttgaaatcaataacacgtttttgggcatgacccatgattagtttttgacaaagttagattcaaaaaccggcagcttggatgcgccaaaaccgaaaccaatcacagcatgctgccaaataaaaattcatctaatttaacatgttttaattatggttcatacgcctggcaaccagtaccaagtgtcctcattttctaattcgacgataccatattaattatacgcgtggacactgaaataatcgctggtacttcgtaattgctcttattatagcaaaacaagctgacctccggcgattaagacgccaagcccagcttgctaatcaattgaattttaatgtcgttgttgctgaatgcacatgccgtattccttaacgacgccggtgtttaacaacagtgaagaaatgtaaaatcattgctaaaagaacgtaaaagacgacgacaaagacgccgtagtaggcccaaaaattgttcagcggaatcaattgttgaatccccgcttcgattcccattgtcagtagtgccattaccgcaatcatgaagaataattgaatataccgtttcaccgtactgtcatccctttcctttttatgtgcagcccgcgcgccgacccgttcacattctgcttgcttagcagctgtgatggtttgcataccccacgttttagttacgacaatctcccgtaatttgatgagaccacccatcgtcaaaaatttatcaagtgttttaaacgttgcgtcagtcacgccggtcaaataattttcaataccacccgcgtaacaatccgtgatcgtcacataatgcttgttcttaaagcgatcaggtactgcttcacccacggaattaaaccgtgcgatccgcccccgaaaacagtcacagaagtttttcattacccccgataagctccccaaataggttggtgcagctaatacccagacatccgccgccattaattttgcttccagcgcgtctaagtcagcattcggttgactatcgtgatctggtcgcaactcataatcgttgaggttgactagttccgtgtcagcgctggccgcggccccctttaagacggcttgcagtagctgggcagtcacgccatcagcgcgatgcgcacctaatattcctaagactttcacattttccactcccatcattcattcaaaagctatttttattttaacgcatttcaacataaaaatatggttatcaaacgaacagcaattgttaaacccgctaatagtacttacttttaacaaaaaggtttgacaatcgattaacgacttgctttaattatacataagtacgaacgttccaataacaattagtctaactgacaacttgtagacttaaagttttcttggctgcaactatttcaccaggacttgaacaatcgagctgtcataccaacacttaacaactaattcagcgtactgccgatggggggagttagtccttaagtgtaaattgaatttgaaaggacgcagtcaccatggctaattttcaacaatccgaaacggcacttattgaaagtgccacactaattaatatattcgccgaaaaaattcggcgtcagattatcattgctctggggaacagtgataatggtctcaacgttactgatattaccgccttggtcaatatttcacgccccgccgtttcacatcatctacgcttaatgcgtgaagctggggtcattgatatgcgtagtaacggggtcgagcatatttattttctcacgttaaccgcaccattacagcaattacaggcaacttttgcgacgctaacggctgataacgcgccacttagtcagtcgtaagcactagcgcctcattcaatagtcaccgcaaccttcaggataacgcgagcctgcaacttacccgctaaacgttagcttgattttagacggttgccaaccaaaaatcggcactgccagaatgttcaacgcattctagcagtgccgatttttattaaccattcatccggatgatcactggtcctaaactgaacttagtcgtgattcaaggcttgcagatcagctggcaatgccgcctcaaagtgtaaagtctgttccgaaaaggggtcaaagaactgtaaactagcggcgtgtaaggcttgccgttgaatccacgccaagttaccgccatacagcgcatcacctaataaggggtgcccaagcgtcgttagatggacccgaatttgatgcgtccgtccagtcacaagttccaaccgtaaccgactcacgttatgctgcaattggtccgcctccacttgatacgtcgtaatggcacgttggcccgccgtggtgaccactcgccgaggactgtcagccacccggccaatcgggcgatcaattgtgccactagccggcgtaatggtcccttcgatccaagcttgatacgtcttcactaattgcgccgcaattcggggctctgtcagcatcccctgcgccacccgatgtttagcaactaacacaaggccactcgtatcccggtccaaccgcgtgatcaggtgcggtcgttgattactggcatgactggctatcaaataacccttgattcgattgaccaacgtatcggtccgattactaggccccggcacgctggttaacccggctggtttattaagaacgagccaattagcatcttcatactcaatttggattggttgttcgctgacgactaccgctgtatccggtgcctcgtctggtagttgaattcccgcaatatcgccatcatgaatggtaataacgcccgtttgaacttgattattgacaagaaacgcgccggtgccatgcttgattgccttgattgttcgcatactgatggcatgcgtcgtcaagaatcgtttcattgccattggttgtccctggtgttgccaagtaaattccatacgtgttactccatttcatctcgtagtttaccaatcagccatctaatcggtttcctcatcggtgctagttgctgattccgcatgagctgccgctcgaatcgtcgccataaaggtttcaccatacttttcaagtttgctggtcccgacccctttgaccgttaagaaagctgcatcgtcttctggcatcaggtcacacatcgaatgaagcgtccggtcagaaaaaatcacaaatggtggtacgccctgttcttccgccaattggcgccgaagtgtccgcaattgttcgaagagggcactgttctctggcaccgtctgctgcaccttttgggccgtctttcggtgtaccgtggtcgttcctttaagcacggccactccactcgctgagactgtcagcgttggatactgaccacccaccgactgcaaataaccgctcgcagtcaaaaaatcgatcagttccacgacactcttctgtcgctgcccggacatcaacccgtacgtcgacaacgtattgaggttcgattcgcggacccgttgattattagcgcccgtcaatacctgggccacgacccctttaccgaaccgggaatgaagcctaacgacgcacgataagacttgttgagctgccgtggtgatatcctgtgattctcgctgatcagtacaattactacaccgaccacacggcgcggatttttcaccaaagtatttcaagataaactgttgtaaacagccttgggtattcgcataccgtgtcatcacctgtagcttctgatacgccaggtgtcggtgctccgtatccatctccgactcatcaataaagaagtgctgaagttgaatatcaaccggtcgaaaaatcaaaatcgcttcactaggtaacccatcccggccagcccgaccggcttcctgataataagcttccaaagttccggggacttgcgcgtgaatcacaaaacgcacgttactcttatcaatgcccattccaaacgcgttggttgccaccatgacgtcaacacggtcgtacaagaaatcctcttggttttgccgccgaaccgcatcatctagcccagcgtggtacggcgtggccttaatatcatgcttttgcaacaaactcgtcagacgcatcacttctttacgggtgctggcgtaaataatcccggcttcaccatgattaactttcaaataatctaaaatgtaacggtccgtgtcttggtccttgaccaccgtcaaatccaagttatcgcgggcaaaaccagtattcacttcatgttgtggatcgatcgctaagcggccgcaaatatccgcagcaacttgctcagttgccgtcgccgttaaagctagaacttgcggatgggtcggcaattgttcaatcgccgtgctgagcgctaaataactggggcgaaaatcgtgcccccactgtgaaatacagtgggcctcatcaattgctaacagttgaatgggcaaccggcccagcgcttgaataaagtaatccgaatctaaccgctcgggtgccacgtaaagtaaggtataatcccccgcccgtagttcttggagccgttcgttaatctcttggaaatccagtgaactgttaataaaagtcgccgcgatgccattatcatttaacgcgtctacctgatctttcattaaagaaatcaatggtgaaacaacgacggtcagcccctgaaaaagtaacgctgggatttggtaacataatgatttaccacccccagtcggcataatcgctagggtgttttcaccggccaacacttgttcaatcactgctttttgccccggtcggaattcatcatatccgaacgtggtctttaatacttgctgtgccgccgctaagtcaatcatcacacgtaaactccctctttgaattaatactctcattctaccgagaataccggcccatgacaagaacgcgccccggtaatcactaggtacgttaagtcgcacttgcgccacgaaaactatcaaaataccgaaaagtgcccgtccctattgattttataggaacggacactttaaagagaccgatatcgattaaacgaccatgtcagattggccatcaaagggcactcgcccacacagtttatatgtacaatgctgacttagccttgcttgggtcggccacggtgatccaccaaaccttccatgccgtgttgtcgatattttcgtacccatgtatagacttgtggatacgaaacattaaaatgcttagcggcttctcgataatcgttgcaatggtccagcgtatactttacgatcgcaattcgttcttccagcgttgcgcgtcgtcctcgatccatgactcggcctcctctcattcactactattcatcataccaagagttctcaattttttgtagctttttccccgtgacttgcctgattcgttgcgatttttaataaattatttcgaatcagtccagtgcacctagcgctcatcttaaaataaatttgttaacgcagttattttgcttgcattcaagaacgtatgttcgtatactcgtattgaggtgattagcatgcagtcagaaaatctaaccgttaagtatttaaataaaagcaagatattaaagttggacccctttatgttgtacttacaagtcacgccattaaaggcgaccgaacctacgcccatcaattgcatcatcgtcaagcatgcgttgactttattttaccaactccaacctgacgcacaactagcactctacggtcactataacaccaggcaccaattcgtgattaccaaattcatggttcgatctgcagtgcaaacactagccagctaatgtacaaagccgctaaaatataagtacttagatcagaggagctgttgtcgatgatgccaacgaacctaaccttacttgagcgtaagatctcaaataacttgaattgtctatactttgtcaaccatcccgtttaccgtattcaaaaggaccatcaattagcactcgcttcagaatacagccttgccggcaacgtgaccgaaattatctgtgatgaacagcagcgctatcatattttattcgtggcgcgcaaagaaattgtcttaactgaaaagaaggtcgctaaagtaaccaataaccagctcgggcaggataccgttcaatttctggcgacgctgggataccagtttccccctgcgcagccggccagtgtactaagccaacccacgatcctaccttcaccaacggaactgagtgaatgtccgaccgcttacgtaatcatcgactgcgagttcggcactcgctttcgtcgtaatggctccgctaaagccgtcagttggcacatcatcgaatcacccgaattacgggctagtatcttccagctcagtgccatcggtttttcccatcatacgcagacagcgctttttttcaatcgttacttcgatgatcctaactttttacctgacaaaaagttggccggtttatcagcaactggcttaacgaccgtcgcttacgaggcacaaggcgaccccttgacgattctaaaagcatttatccagcaagttatccagccacaactccccctcgttttttgggatcagacacaggacatgaaacacattcgattattactaactcagtattatcagcaattgacccccaccgaacagcagctagtcagtcgcccggtcacgatttttgatgcccaagcctatacgaataccttgatcaatcgtggcaaccataaggtcggtagccatgatctgccattaaatggcttagccgcactctttaatatcagtaatccacaccagcataacgccatttgggatgttcagacaactgaattagtcatggttaaacttgctgaactaactcaccaaacgccggtaatcactacaccgcctgcaccggtcgcactaccagctacggtgccagcgatggttccgtcaatccagacgcctagccccacaccacaacatgccagccacgcgcaagttcaccagttacgggcacgtggcaagacttaccgtgaaattgcggcggccaccggttttagtattagcgggattaattatattctcaaaaaagcccgttctatcccgacccgctcagaaagcgtataatgatattaatagcttaaaaggagtgttttaatatcatggaaaaacgtattaaaggttcatgtaccacgattctcgtcggtaaaaaagcctcaatcgatggctcgaccattatttcacgaaacgatgatggtcacgaagccctagaccccgaacgattagttgtggtcaatcccgcagatcaaccccggcactatcagtccgtcattagtaaggtcgaagtcgacttacctgacaatcccttacggtatacttcaattcccaactcaatcttgaccaatgggacctggccagcagcagggatcaacagtgagaacatcgccatgtccgcaaccgaaaccatcaccacgaactcgcgtatcttgggaatcgatcccttcgttgccggcggaattggtgaagaagacctttgcaccctagtattaccatacattcacagcgccaaggaaggcgttactcgtctaggtgccctgcttgaacaatacgggacttacgaaccaaacggtatcgctttttctgatcaagacgaaatctggtggttagaaaccattggtggtcaccactgggctgctaaacgtattcctgacgatgcttacgtggttgctccgaaccgcatgaatattgacgatttcgattttaacgctgatgataccttagcttcagctgaccttgaacaattgattgaagattaccacttgaatcctgactttgaccgtgtcaacttgcggcatatctttggaagtgcttcaatcaaagatacggtttacaacaacccccgggcttggttcggtcagaaatacttcacgccggacgttgtacaagatccaatggaacaagacttaccattcatctgccatgctaaccgtaagatttctatcgaagacgtcaagttcgttttgagttctcactttgaaaacacgaaatacgatgtttacggaagtggctctgaagctgacaaaacccttttccgaccaatcgggatcaaccgtaaccacgatgtgcacatcttacagattcgcaacaacgtccccgctgctgttgccggtattcactggttagcctttggtgccaataccttcaacacggtcgtaccattctatgcaaatgtcaatgacacgccagctagctacaaagatgcggacggcacctttaatctcaaccacatgtactggttaagctgtacaaccgcccttttgggtgacaccgactacgacttttacgtggatatgcggaatagttacgaactcgaagccatgagtgcttaccgtaaaatcgagaatgataccgacgctgacttggctaaccaccaagacgtcacggcctatcttgaaacggctaaccaacaattggccgataccgcgatgaagttacaaactaaattactcggcgatatggtcattgccggttctgaaaaaatgaaattacgttataatttgaacgattaattaagcccggtagcttgcggttttagctaagatttccatggtgaattcatgagactaaactaatttatttttaatttagtggtttacaaataccagaatcgtgctaatataaatgtcacaagataaaaaacggaggaaagaggagtacgattagtcaacctgccagtgaatcgggagtgagtggaaacccgaccagaacttgactaatccgaaaaacactttcttagttgctaactgaaataacctcgttaaagtaggattagccgttaaccggtacgttaccatcggtggtgtatgtttgtacactattttaaagctggtttactgtaaggtaaacaacttgggtggtaccgcgaaagagtctttcgtcccttgataattcaagggatggaaggctcttttcttttatcctgtaactaaaatctgaacttattttaaaggagaccacgcatatgcatttaattattccaaaggattacgatcctaaattatccgttaaagaaacccaacaggccattcgttacattcgtgaaacgttccaagatgaatttgggaagcaactaaacttatctcggctttcagcaccgatgttcgttgaaaagaaaactggtctgaacgataacttaaacggtgtcgaaaaacctgtctccttcactatgcaagacatgggtgatgaacaaatcgaaatcgttcactcacttgctaagtggaaacgggtcgctttaaagcgctacggttttgatatgcatgaaggtctctacacgaacatgaacgctattcgtaaggatgaagatttagacaattaccactccgcctacgttgatcaatgggattgggaaaaagtgatcagtaaggaagaacgaaccgttgaaactttgaaagccacggtacgtcaaatatttaaagtgatcaagcacatggaacacgaagtttggtacaagttcccacaagccgttcaccacttaccagacgaaattcacttcttaaccacacaagagctcgaagacatgtaccctgacatgacgccgcgcgaacgcgaaaacgccatttgcaagaaactcggctgtgtcttcttaatgcaaattggctggaagcttgattccggcgaacgtcacgatggccgcgcccccgactatgatgactggaaattgaacggcgatatcctcttctggtatgaaccattagaccaagctatcgaaatctcaagtatgggaatccgggtcgatgctgaatcaatgaagaaacaacttaaagacgtggacgccgaagaccggcttagcttgccataccaccaaatgatcttgaacgcggacgtcccttacacgatcggtggcgggattggtcaatcacggctctgcatgttattacttggcaaagcccatgtcggtgaagtacaagctgccttgtggccacaagccatgatcgaccaatgtgccgaacataacattcatttactttaatctgatttaaaatccaacaagaaggagtgatcaatatcatggaaaccattagtattatcaacgccgctgaccatgtcaatgaacaagttaaaattggggtgtggatcagtaataagcgttctagcggcaaaattgcctttcttcaattacgcgatggcactgcaacttttcaaggggtagctctcaaaaacgagctcggtgaaacagcttttgcacaactgaccgacctcgcgcaagaaactagcctctgggtcaccggcacgattcatgcagatacccgttccccctttggctacgagcttgccatctcacaatttgaagtggttgggactagtcacgactacccgatcacgcccaaggaccatggtattgatttcctgttggatcatcgccatctttggctacggtcatcgcgtcccaacgcaattatgcggattcgcaacgaggtcattcgagccgtttatgagttcttcaatgaccgcggttttattaagattgacgcgccgattttgaccggttccgctcctgaagggacgactgaattattcaaaactgattactttggtcaggacgcctatttatcacaatccggccagttatacggtgaagctggcgcaatggcgttcggcaaaatcttcacgtttggaccaacttttcgggccgaaaaatccaagactcgtcgccacttaacagaattctggcaacttgaacctgaaatggcctggatacatcaagatgaaagtctggaagtccaagaacaattggtggcctacctcgttcaagccgtgattgaccattgcccccacgaactggccgttttggaccgcgatgttgcgacgttgcaaaagtacaccaagctcccatttccgcgagtttcgtacgacgatgctattacactactccaagcgaacggctttgacgtcgactggggtgtcgactttggctcaccggaagagacatttttggcagaacactttgaccaaccagtctttgtcttaaactatcccaaagcaatcaaggccttttacatgcaggcacacccgacgcgcgatgatgtcgtcattgcagctgacctgttagcacctgaaggttacggcgaaatcatcggcggttccgaacgctcaacggattatgactacttgaaggaacggttactagccagcggtcaagacttgcaggattacgagtggtatctcgatttacgcaaatatggttcggtgccgcactccggtttcggtatgggtctggaacgttttctggcttggatcactttgcaagatcacgttcgcgaaaccattccgtttccacgtatgttgcaccgtatttacccgtaaagtcgctccaacctagtgctagtagcattggttaatcaaaattaatcgtgcatcctttaaattccccacgcattttcgaatgtgtggggaattttttatcttatttgttgacaagcaacaatattcaagataaaatgttgcttgtcaacaaaattaaggagctgtttaaaatgacaaaattattaatgattaatgctcatccacacacgaccgtccccagtgcctcactgaccgttgcagcgagttttaaaactgcgtatcagcaaacccatccgaacgatgagattacgacacgcgatctttatcaggacggcgttcccgctttgaacgacacaaccttcgaagcttggcgtaaacaaaaatacggtgaagaactaacgtcagtggaagctgaactacttagccgtcacgccgcctggctagctgaatctctagcagccgacaagatcgtcttcgttaatccaatgtacaatcactttcttccagccgaactcaaacaatacttagacttaaccgcagtcgcccgtaaaacttttaagtacacggtcaacggcccggtcggcttattacccgacaaacacgtcttacacattcaggctgcgggtggctactatcaccaacctgatcagcacaaccaggttgaagcaggcgacccctacctccgtggcatgatgcaactgtatgggattcaggattaccgaaccatcttcattgaaggattggaccaatttccagaacagcgagaacaggccatcactgccgcacaggtagcagcagaaaaactcgccggtgaattttaaaaccggtataataatagtaataaaagctaatgattaattgataattgcgcgctaaccaccacgagaaccagtcgccatgacgcacaactatctaagggggatcaatcgatgtcaatatccacggaacagacaattctaacgcagctcaaaacgattcgaaccaagcgtgcttccactactggtgaacagaaatggttacagcagcatatcaccgaagccaatctacgccgcctgttgccggatatttccatcgttggcctacatttattatctgaactagaggccggtccacaaacgggcatcgacttagccactaacctcggcgtcactcgaggtggtgtgacccgggcagccaaacgactcgtaacgcagggcttaattggctcattccagcaacccgatgatcacaaaaagatcttctaccgcttaacgccgagtggtcgtaagctggcccgctatcatgataagatgcatgcaacccgcaatcatcaagcaatcacgctccttcatgaacactactcaccagcagaacttgcggtgattcaacgcttcttggctgatttgacggattatgaagcttaataaaaccaaaaacaccgctacgactaatgcgttcgttagtcacagcggtgtttttgaatttctaatgattagtgattttgtaatcgatacttgcgaattgccataatcaatgacaacgtgttgagtaccaatgataaactgctgaggagtaaactcgtttttgtaatacgcatgagcggcctccattgattgaatttgttaattctagtttaccggtattacgcactaaaagatactaaaagcactaggtgattcgtggattgtgcgatcagtggttaatcatttgacacggtctgtttggcctgggatagcgcgtccttgactgcggccttgatggcacggctcgatacagaagcgccggaaactgcatccacatcataagtgttagcagccaccatttttgccggcaattcggcaactgcctgaccaccaacttcaccagtctcatgttgttcaactacttcaacatgagttaattgttggtcaacatacgtgatacgaaccacaacttgcccaccaatgccatcatctgagcgccctaagtattggtgttcaccaactgtgatgtccggtgatgcttcagctagcaaatcattggcaccagtctgatgcaccgaagcactagtattcgcatccggcttagccactgctttttcatcgactaattgtatcgtttcttccttaggtttagctgcattttcaccagcgatttttccaaaaatcaggcattcagctaaattaccgccaccttgatactgatttgcacaaataccgcccaactcacctgcaccatacaagtgcggaataggttgctgatttgcatctaaaatttctgcccggtcattacgacgtggtcccccttgggtattaagtacgttgtttgttaacttaagcgcataatatggtccatcatcaaatgcccgcatcgtatcaacctgccgattaaacgcgtagtcagtaccagactcgacaaaataattgaaatcatgaacggtcttggtaagtaccgtaccatcaacttccataactcgtgctaagtcgtttagagtagtggccttcacaactaaatcggtgagattattaatcggcgtatattgacttgctaacatctgttgatactgagtttcatcaaaaaccaagtatggatggacatttgtccgcggtactcgccacattccatgatcataaatgtgaccgtgccggttggcttcactctcatcaaaataccgactaccgtcatcagccaccgtaataacgctaccatggttaacttccggccagcctaaaatcaagcgaccacgttcaccttgtggtacggcaatcgaaagaccatgtaaaaatccgagtgattcataattttgcatgtgccaaaagtccgcgccaacttcttgggccatcttaataccagcacccttattaaacagcgtgcctaatggtgccaagtgctcagcaccaaggtagtcctggatggcttgttgattattttcaaaaccaccacatgctaggactacaccattggtagctcgaacattaactaaacgatgctgacgttcgatttggacaccgataattgtattcgtagtgggatcttgaatcaggtgttgtgccggagcactaagccagacatcaatctgttgctgccgatctaacactttttgtcgaagaattttccacaaagctgcatcaaaaatgccatgatggacagttgtaaagtcataggattggactccatcaaattcaggaaactcatgaactgcactgtctaatgaaattggagaatcagcagctgtaaaatcatttttgacactcaccggttcaacattgagatacttttgaacatagtcgcgcatattcgccatgcccgctatgaaagtatcaaccatactatcgtctaattgcatgggtgccgttaagttttgataatattttttaccctcatcgaaactatctaccgttcctaagagttgggcagaataacgggtattgcctccttcatgcccattcggcgctgcatcagtgagcaacaccttcgcatgtgcatccgccgcaaaccgcgctgctgtcgccccggcaccaccaaagccaataactaccgtatcatattgataatcccatttaacctgattcatttttttgagcatgctgaccaccctttcaaaatccatttaacgtattctaaagcacaattgaaattgatatttaaatcacaaatagaatcattttttaactacatctgtattatataaccgctttcatttttatagaaataacaatctgattatctgttattacaaatgagtaatgggttatacttgattttaataagattaagcattaaaggtggcgatttcatggaaaataaattgttagtatttttagaagctattcaacagcacaatagtatgacgaaagctgcacaaagtttattcatcagtcagccgtacattagccgcacaattaaaagtgcggaaactcattttgggacccccttaatcgaccgcggccatcatccacttgaattaacttatgctggagaaagattactgacttatttgcaaagtgacgctcgtctccatcagcgaatgaacactgagcttaaagaaatcagtcaaaataagtatcaaagtatgacgattgggattacaccaccgatggctaatgcttggtttagtcaaacactacctgctttttatcaacgttttccgaacattcgcactaaaatactagaaatcacaacatcaaaagcagaaacgttgctggctagtcatcagctagacttttttattggcaaaacaattcatcaaactaacgtcaaaaccatccctttgcagacaatttctttgtctttagtcattccaaaaacagccggaatatatcagtccaatcaattttggcgaccgttcacccccaccattcttacaggaatgactggtgagcctgtcatccgtgcagtcggtgaagctcgctttcaagaactggttgaccattactttaccgataaaggcattcaaacgattccactcattgaagtcgataactctcgctttgcactaagcttgacacttcaaggacttggtagcattgttctagccactgcaatgttggcaagactagccactgaaccagccaagtaccctatcaatgcgttcaaattaccaacaagcgagctcagccttgattttagtattgcctacttaccaagtcacgtgctagctaaaccgattgcttatctagtcgaacaagcttgtcaaacctttaaccctgcgattgatttttaacataaaacgcaaactgtcagcatctattaagctagatgattgacagtttgcgttttactttcaaaataaatcaccggtagtaaatcatgttcaaccccaccagctgttgcattagttgctcattttctggtgatagtttgatttgttgctgccgcagacatttggagatgtctaagttcattctgtcgaatactcccagtactgaaccagttcgttgttccaatagttcctgataataagttgccagcagctgtcgtaacggttgctcattcgtggtatttagattagcaactaaatcactaattatgcccacagcaacacgtgcccgatcctgccccccgctgtaccatttcaccgtcatatctgttcgactccttttacgcaataacaactgccaccatggtcgctgaacaggtcttctgctcaaacctaataactcatccgtcgagacagaaaatagtttgctcagtgctaccaacaactctaaatctggataacttttccctaactcccacttggaaatagtttgccgtgagacgtgtaaccgctccgccaccgtctgctgggaccattcatgctgttgtcgttgctcttttattttagtaccaatcacaattttcatcctacccgctcctctattaaaatactagactattgggtgcaccaattcattgcaacacacttaagcgctaccgcaacggttggttgcaaccactcaagatcaagtctcggtatgaaaatgttgatacaacgactttcctgaaactaacaattccacaacttgttgaggatcatcaaccgtcacaccttgtcgttgcaaataactgacaaattgcggtaaatagtcgctggccttcaacgcacattccagctgataagtttgggcattagtctttaaaatcaattgaaaataatccggattgaaatcaaatggtgaaagtcgtttgcgacaccgataactgatggtaactcgctgcagatctgtatagtggattagttggcaccgtggacaattgaacacaatttggcgaaacttcgtcaatgtcgatgcagcatacgtatgcaattcaatgatagcaggctgaatcacccagtaactattgattcccactggaacgaccacaatcaatccaacaatataaagtgataaaaagagccaccacggctgataaccaaaaccagtaaataatagacaaacaaatagccaaaataatccgagacccagaagtcgcccaaagcttagtcgccgaccaacaatatatggctttggaaagaaaacactaccacgcactaattcatccaaggatagattatacagatccgacagtgccagtaaattatcgattgacggaatcgcctttccgcgttcccacttagacaccgcctgagtcgtaacaaataacttggacgctaattgtgcctgtgtcaatccatactgacagcgacgcgttttcaataatgctgcgagtaacattggctcgcccccctttatgatttcagcttaatcctcaaccacgatcaaaccaatcaactcatggttgtttagtcacaatcatgtatggtagtcataatttgttgaacttccgtggttaaatcttgttgctcgccaattaagacttcgttagcaacgcccaacgtatcatgtggaagccaccaccgacgcatgtcttccacaccaaaatcacgatgacgcttttgatgacgcgccaaggtcgtggcaaagctcacttcaaaataataagtaaggacgcgtggaaacgactgactaagccgcgccaacatttttccataccgatcacgtgctaagatgccttccacaatgactacaggcacacgtcccagcccataacacgcaatttgttcaatcagaccaattgaaatatttcccgggtaatcatgactcatcagcatgtcgcgacgaacgacatcttgggacactagcaacgtatgatggcccacgcgtcgttgcaacgcctgcgctagcgtcgtcttgccactcccagaatttccccgaataatcaccaaagttgtttccatccacatgtcctccactcattcctgtatcttaatcataccgcacagctaacaaaaaaacgttagccaaattagctaacgttcgctgatactatttggctttactggcgttacgtcgggcatcatgtaaaatcttcaatgcgcgtttccgcgattttaagttggtcccccgtagacgcctgcgcgcacttgctaaatcttgtttttccatcatgggtgcctcctgataaatagtaattattaccatttaaattataatcaatcttatgcttacgtcaactattatgcagccagctgacattgacagatacaattagctcccaataattaaattatcatttattagactaacggcaatgacaatgttacccttaaattgtcaacgacattatataagtattttgaaggagtggggatctttgaaaccaaacaatgttaataatcagaataaacgtcaccaatcgcgatgggtaatcacgagcgcaaccgccatgatactgacaacgttaacgattgccagtcaggcggcggctgccgacgatacagtcacgaccacaaccaacgaaccgaccaacagtcagttgaatacgaatactcaagttaacgctactcaggtcaatttgaaagcggatacttctacatcagtatccacgataaaatccgaccagtcagcagtcgcagccacgtcacccaccacatcaaccggaagtccctctgagcactcgtcgtcagtgaacaccaacccacaacaacaatcagcaaatccagcatcacaatctcaagcaactaccacgtcagaatcaacaccgaccacagatattaagcacccaactcaaaccgcaccagctcaaacaacctccgcatcaactactgaaccaactaccgaatcaaacactgaatcagcgactgatagtcaagctaaagcaacgacaaccgataatcaagcttccaagcaaccaagccagcaagccgtacccgcgtcgtccaactccactaccaccgaggtgaatactcagtcagcgactagctcagcgtcaaccgatgataaaattgttaccaatgtaaaccaggaaaagctggttttgaaaactaaccaaccagtcgtccgtgccattagccgcaccgcgtcagaaaatattaacgattggatgccgaacacgttattgcaacaagaggtactcagtcaactgcgcaaacagaacccagatcgtacctggaactcagctgcagacatcactaaggcagatatgctactactgaccacctactatggcaaggacacttatatcgacggcaagacttcctactcattagaaggactgcaatatgccactaaccttacgacagtctggctcaacaacaacttgaacgcaccgtctggcagttactatagtgatgtcactgatatttcaccattagccaacttacaaaaactccaagtggtcaatattcagcaaaaccggatcacggacatttcaccgctcgcaaacttaaagaatttaacggaggtcgatgccgcctataaccacatttcagatttttcgccacttaaaggatttaaaaatctgaaaggcacattcagtaaccaatttatcaccttaccacccgcctatattagtgcagataataatattgcgacgctggcgattgattgctatttgccagatggctctaaagttcaactgaagcccaataatggcgtcggtgaaactgttttctacaaaaacggtcagctttacgttcgctggtactttaacggtgcgggcggtggtaattacgacagcaacggtcatatctactacacgaatatgaagccccagcaacccggactaacaggtccgacctttaacggtaccacggttattcccatggacgattattatttcatgaccgccgcttctgacggtaacaactttgtcgtcgtccgcccgtatgtcttagctgccactgctgcgcccatcacgatcaaatacgtcgacgcgcttaccggtgaatccttagtcaccgctgacctcaccttaaacggaatcgtcggtcagccttacacgactcagcgcattgatgacgagctaccaaattatgactttacgaacattgtcggcaatgccagtggcgtcttcacggcggatacccagaccgtcacttattactatactcgtaaggacgccggcgacattacgattcacatggtcgatactaacggcaacttagtctacgaaccgcaaattctacctggaaaacacaatctcggtaacgcctacaatttagatgcgccaacctttgaccattttaaattacagcaaactatcggcaatgcggctggcgttttcacgactgatccgcaaagcatcacgtttgtctatgtccgcttagacgccggtaacattacggtgaaatatcaagataagcagggacaccaattaaagcccgataagacaatttccggctcccaatcactcggccaagcttatacgactgaaccactagacattgaaaattacaccctgatgacaacgccggcaaacgccacgggcactttcacagatcaggaacagacggtcatttacgtctatgtgcgccgcgatgctggccagattgttgttaagtatcaagatagtgctggtaccccactagcacccgacaagcttttagacggcaaagagcagttaggagcagcctatcaaacgacagccatttcaattcctaacttttacctagccgccacacccgcgaacgccactgggaccttttcaaccgacacgcaaactgttatttaccagtatgcgcgctcgaatgctggccatatcacggtgaagtatcaagacgctaacggcacggctttagctcccgacgacatcctaaccggtaacggtcagctaggtcgcccctaccagacaaacgccaagacgattgaaaactaccgcttaattcaaacgccagcgaacgctactgggcaattcagcgaccaagcgcaaaccgtcatctacgtctacactcgcgaggatgcgggcgatatcacggttcagtatttagacgaaaacggccagcagttagccgccgatagcgtattaagcggtcaaggtcaattaggacagccctatgaaacgtcaccgctgaacattaacggctatacggtaaaatcgacacagggtaacacgactgggacctatactgtacagccgcaacgcgtcgtttacatttacgagcggacagctggacagccggtcactgccaagtatcaggaccaagatggtaagtctatccatcctgacgttgttcacagcgggtatttgggtgacaactactcgaccgaacaacttgttatcgacggctacacctttaaagccgttcagggtgacgtcagtgggacgttcgggacttctgctaagactgtgacctacgtctatgaacggacggctgggctacccgtcactgccaagtatctggatgagcatggtaagtctatccatcctgacgttgttcacagcgggtatttaggtgacagctactcgactgaacagctggttatcgatggttacaccttcaaggctgtgcagggtgacgtcagtgggacgttcggaactaccgcgaagactgtgacctatgtttacactgtaaacacccccacaattccagatacccaaggaaccgttacggtgcattacatgaccaaggacggcattaaactaaacgaaccaaccgtgctgagcggcaagacgggaaccacttatcaaaccgtgcccctgacgttcactgatcatgaactcgttggtcagccggaaaatgccatgggtctcttcactgctgataacgtagacgtcacgtacgtctaccaagcaactgacacgactggtaccgacgatattattgatcccgaagaaccggaacaaccgactaagccgattaagcctgttgagccaaccacacccgagacgcctaacgaaccaggaacgaccgtaacgcagccggatcgcattaagccgactcaaccagcggtagctgtaaaaccagcagcgaccgtgaaaccaacgcttaaacccgcggccgcccaggcaagtttggtcaaaacaacgagtcccgtcactgaacactcagcccagttaccacaaaccaacgaacagactggcaaattagcggtcatcctaggactgttattatccatcgtcacgttcgggttctatggtaaacatcggcaatcataacgtcatcaggtctaacgaaaacgacacttcatttttcgaagtgtcgttttttctgatcaaaggtgcctataatgaaattaataattataattccgatgaaggaagtcctaatcgatgaaagtctatctcattcgtcactccgaaccaacttatcaacaggtcactacagctggattaactggtttcggccgtgaactcggcggcttaaccgaccgtggtattatgctggcacaacaatgcgcccagcagccgttatttgcacaagtccaattaattctgtcgtccccctacacacgcgccttacaaacggcactggaaattgtgcgttttaatgatatcccactaaaggtcgaacttggattacacgagtggctacccgataacacgggtagtcggactgataccgatgaacaagcgaccacggcctacaagctctatcgacaacacgccggcaagcgcaccaccgctagtcccctcccctacgaatcagcagctgaaatgaaggcccgagttttggcaactttgaataagtatgccgcatcttacgattgcatcgcctgcgtcacgcacggcgaggtcatgcagcagtttggcgatcagaaagacgtggattattgtggtgtgcgtgttattgcggttaattgacaattcataagcagtcgccaaacaatggtcgcctataatgaactatcaaccactgtcaatctaataataatcaggcttaaaaactgcgaaacaagtgccgacattcgctaccacgccatacagtctttggcaagtactagtatatcgcctatatcactcataatgaagtcatatgtcaatttaatggctgaacacaacttaaatactgtgaagtagaaacgattaatcatttgacatgtttaccctggcctcacaataataatattcatttaataattatcataaacatctagcaactaccgtctcaatacaacttaacttttggcacttaataaattaaattgtaagttagcctcttcattactattgtgttttcctctccgtatcccaatgtcttgattgattgattttcattttttgagcaacaatctcaaatggatcaacctgtagcttttcacacatataaaatatataaattaacgtgtcagctaattcttcttgcaaatgttgattttctctattatccaacttctgattagcattatgccactgaaaaatttccaaaacttcactagactcaatgtttagagaaattgccaaatccttcaagttatgatacttctgccagccttttttattacggaattcgattaatgcttgttctatctccgaataattcaattaaatcacctcaaaatatgttgatttccagctgcccttagtaaggcctgttgtagttcctcatcgacagcaaaaatatataacccatggacaccacgagttaataaaacatttagttcgttacgtaacaattcttcggaaacgtcaattttttgatgtttccatgttcgttgattcgtggcttttttattcttactagcttgtttatcaaaaattaactttccgtctcgatacttcactgatgggccgataatcacaccagcataattcaaatcaaaaccttggattgtaaatgttgagccgacctcattaattgtttgaaactgttcggcccaagctagccctttgtttcttcgcttttcttggcgagaaataggaatctgcaaattccatggcaaactccacgtcccaatctttactcgccaacagtcaccatcttttggttttcgtttctcaacatatggccaatcaaacgttgccaacattctggcaagactagcaccgttactatttttcaatcgatctagtgccttgattttagcgtgtagtttttccggagatgtcgcgattttaagttgatattgtgcatcatctggaattacattaatgcgcccatcaattgcaaaatttcgtaaccagtcaatagtacgctgctcggcaatcattcgttcctgatgtgttagctcaattcgattgccttcacgttcagcatcatcttccaattttcgaacagccatgtcgtccaagtatccctcggtagttagtatttgatacttatcaaacacaataactaccactttggctaactttaataaatcctctagctgattatgtccccgatatgccatctttccttgagtcaggagtaaatgagcttcatcaactagtacaacatcaacttttgccgcaccagtatgtttctgaataaaatgagtaggtttggagacgatgtctttatgttcgtgatccaaacctaatttatgtgcaatcgttttataaactgttttttgttgatcgtgattaactaataaatatactgaatctttccgcactaaactactattcgttaagtcgtaaaacaaattactcaacaacacggttttaccagttcctgcctgaccggcaataaagattgtcttaccgcgttccgtagatgattccttcagtgcagactcgattttaccaaaaatctcattcttactttcatgctgttcagcatttaaagagtggaaaggtgacgctttgaacacagcagaattttcaatttctgatttttccggaaaaatctcaggcttttttttcctaagcgtttgccagactccttcaaacacattctcaaactgatccgacataaagtattttcgctgcggatttgagcgtcgattattcaattgagtaacactctccgcacttaataaatacatcatcaatttattttcaatgtcgagcgttaggaatttgttaaaataatagtccccaattacaatcatctgtgaattatgactctcatttaatgctttccaatccatccgtgactttccagtatcttttaaatgttgtcgtgttcttctacttatgtcgttagtttctccaacataaactttgaacttagggtcattactactgcggccagaaacctaatttatcataaattaaatagactgtcggatattcaaatatcagctctctattctgcatatctctatgtaggctaacattataaccagtattttatatggaacaatttctacaaccggctcaatgtcgccaatgttttcttcaattttgttgtatcgcatatcttcatcctcgtgttaaaaaatctatctggctttattatacatgaaagatcaagggacaaaagagcttacaacacaaactaaaaaggtagcccgcgctgaaacgtccagcaccgaaccacctttataacgaatattaacttattttacaacttccgcgaccgccgcattcaccgcatcacgttcatcctcaactaaggcaacgcgactggcgattaccttcgtatccatcttaatttcacgcgttaaaccaggcgtattgatttttggttcaaagaacgccttgaattctgctaaacgttcagccgtatggaagacccgggaaatgacggtgatgtaagtggtaaattccatgtcaccaccaaccgtggcttccaaccatgaccattcgtcgcgaatccaatcccaagctgcttgttcaccagctggattagccaagacgccgcggaaccaggcccgcaagtcttgtggcttaatcgtatccgcatcttcaaacttcacaactaactgtttgattaattcggggtccgtagttgcggtcaatgcgtcacaaatgtcagccttgtaactagcatcggctgtctgccgtgacgccgtcaataaactatcgaataagtccttactaccaaagttcttgacttcattccgtaaaatgaagacccgcacatcggctggtaaggtcgctaacttatctcggttaccttcgaataattcatgggcagccaatacggccgcgctattcttggcgtacaaagccgcactcaagacgtatggccgcgtcaactgatcatcgttggattcaccagcttgtggcaaccaccctaaccgtttaacctgagcggcactcaattggtcaaataacgtttgtaaatgcttttcttcatcagaatctggcgtaacaaacttacgtaagttacccgcaacttggtacaacgctgcgttaacgaccgttgaatggctggctgcaaaccgacttaataatggcacaacggctgcgtatgagatttgacgaccttctgctaataagcgtaagtcttgtaacaactgtaactggtcaatagccgttaagtcatcaacatgcgctagaatatcatccaataacgtttggtcatacttgacgatgaagtgggagttattcccaacgttcaagcggaatggttgcccactcgcatcacgtaatttggcataatcgccgaccgtcacagcttggtccttcataatcgccggtgccgcctcatagttgctattcaacggaatctgccattgacgaccgacttcttcaccttcaccgatgaagaactgttgttgtgacaaggtcaactgaccgtcaacaaccgctgccgtgaccactggatagccaggttgttccagccatgaatgcatgatgtccccaacttgcatcccagaagcatccgctaaggcgttccacaagtcatcacctttggcattaccatatttatgattgataaagtactgcttcaaacctgctcgtaaggcatcatcaccaactaaggcccgtgccattactaacatccgcgcacccttagcgtagacaatcgcaccgtcaaaaatcgagtcgatttcggccggatcttccacctgaacgtggactgactgaaccccatccgtggcatcccgttgaagcgccattgatgcttcggacgtttggaaagtttcccaaatatgccagtctggttctaaggcatccgtcgccacatattccatcatgttggcgaaactttcatttaaccagaggtcatcccaccacttcatcgtaaccaaatcaccgaaccattgatgggcaagttcatgggcaatcaccgtggcgacccgttgtttcgtttcgagggccgtgttgtcaggatctaatagtaagtaggcttcccgataagtaactaagccccagttttccatcgcaccagctgagaagtctggtaaggccaattgccatgagtgtggcaatggatatggcgtctgataaaaatcttcataaaattcgattgagcgcttagcaatgtccaaagcaaagtcgagctcgttagccttgtgggccttagtaccgaaaacaccgatggtcacgccactcttggtcttcgtctgcttgccttgtaattcaccaaaggcaaacgcaatcaagtaagtcgacatccgcaccgtggtttcaaagtaatgcaccccatcggcttcatgatcttcgggcatgttgcttaagattgtttcaccatcatgttcatcgtacttgatggcaagatcaaaagtcgctttagcttctggttcatcgacacacggaaaggcttgccgggccgcggtcgtttcaaactgcgtcccgattagttctttcttcacaccgttgacttcgtaatatgatgggtagatacccatcatcgtgtccgtcaatttggcgctgtacgtaatcgtcaaagttgtttgaccggccttggcaagttcaattcgaattccttgaatcgcatcatccacagtaaagggcacgtccgcaccatcggcttggacaccagcaatggtcaaaccattctgatgaatcagcacttcctgcgccttagcatccccggtaatcgttgacttccccgaaatcagcttatccgcccggttaatattgatataaagatcgtaatgttctggttgaaatgtttcgtaaaaatgagttgtggttgccatattattctcctcgttttttaagaatatattcattatacgacaattatcactttaatgccgtattcacgttgccaagacaaataaaaaagtgttggctcttaccaacacttttcatgaagcacttagccccgatcgtctacaatatcaattcgatagtgaactcgattttgtgcaccactttcgatattttcaataactaagtcatacacttgattgcgatcatacggctgatccactaaggtgagattggctcgccatattctcttttcaacttgggtatccttactatttgcattaatcaggatttgccctgaaatttgatgattatttttatcaacaaagtatagtttaaaggcagctggtgttactttagaactaattggttcggtttgcataatacttaacggtacctctagtgaggttactctcaaattagaattattaatttgtaaggttacctcatgtgctgtcgattttttactggttgtgcgtacttccagtaacgggaccaccatttcttccaatgatgatcctccatgtgcataattatcaccaccattagccttaaatacgttagccgtagtcggataataaacataccgtgaatcttgattttctaaaatattagctagggcttgacgttcaacacccggtaccttgatgtcacgttcagaaactaaataacgtggtgatttccaatcctccgcaaccgttttaacttcaattttgtcgatatcagcaatcttttcatcacgatattgatacccgtgatctgcagtaatataaacatgattaatactgttagttcttaatcgccagattaattcttgcaattcgttaatcgcatttttagctgcagtggcagtttcatcttcggttcctttattctctgctgtagtatcaatctgattgtgataaatatagattacttcttgattgacaaacatggatcgaagttcatcacgtgacttaccttgcaaatccttaaaacgatatgccgtgcttttagggtttgcttggcgcaatattgcttggcgttgttcgatattacttgcgggctgaccatcaacggttacccggcgctcttcagcctgtaatgctaagttgtgatgcggtagcaaagccggcatacccatataggtaacggatggcaaaccactaattagaaaatgcatctgcatatccgtaacttgatcctcttgctttagttttccttgtaattcctttccaacttcaaaacgaaatgaatcagagataataactacaattcgattttgttcgttgcgaatatactgattataaaaatttcgttgcaaaagttgtggcgcaatttgctgataatttagactctgattccagctaatattgaacttggataacagaacaacataaattcgttctaccaatcgttttaatcgcatatagtaatctggataaccagcaatacgatattcataaacaaagtgacgataattcatatcaatataataaccaccattagtatactcatcaaccattgcgttgaacccatttgcgggccgattgtgacgagcttggataacttgccatgcacttctgaccatcaagtacaaatgattggtattatgtgagcggccatagtgcatttctcgacgtttcttagtcaatttaccaatacttaaaccgtcaactagaacttcatcattttccagcaacaattgctcttgaatccagttcaaaattctccgatcaaattccgggaaaacatcgctatttgcaagatcatcaatatcaagttgatcaaaaaatttatttactttaatattctcccaaacatgccgtgcaatctgatcataatcatcacgatgctgattgtaggcttcagcgctaaattgttgcataaacgtttggacattggccgcccgagtactcaaattgtaacgattatcagctgccgtcgggagtcccatttgttgaaaggccatcgtgacatacattccagacgccagtgttaataaatctggctgatcagactgaaatccaaattgatcactgattagtctccaaaaatcattgatgacgtgatatttttcaaattcatttaaatacttgttatccatcaatccagccttaagaatcagtcttaatatcgcaaaaaaatctactaagggctgatccagccgaacgatcgccgccataattgcaactgttggttctgactgataactgtgcaagtcatacttcatgaaccgtgcacggcgttccttacttccaaaaaatgccgtatatctttttacaaatgaatacatgttctcaggtaattgcagttctttacgcaaaatttctggtgcatccgctctgaatatctcagagtacagcaccatatcgcgtaaatggttttcatctaatggcggttgtggttgcggcgagtaaattaaaaacttttcgctcatgcctgcccccaataaccgcaactttgtttttaattggtgtcccatctttaactcaactacagtggcgacacccgctagtgctctggtcaagtcacggacactatcctcaaattcgccctggtcgtcataccaaaaaatgaattgatggcccgccttaaatttactttttaacgttgtcacaacttgatcaatatttacgtcagccataattactcctcgtttcaaaaaattcaccacccttatcataccgtattccccgctaaaactcacattataataaatttaataatcgttcactccaaactatcatgccggcgttattcagcacctaattaacgatattgatgaagcagattttgacgttactcgtggtggtcaggttgaaattattgggtggctgtatcagtactataatactgaaccaaaagaagtagcatttaaaaagcgtaaatatgctgaaactgatattcctgcggtgacccaattatttacgcctgattggattgtcaagtatatggttgaaaattcgttgggccgctattggattaatgttttacatgctagaaatgattcgcgatcagaagtagaaatagcacaggcctatcattggcaatattacatgcccaaatctcagcaaaacgaacaagtatctctaaagattatagaggcacaaaaagagcttactgaagtgaaactcgaggatattactttagtggatgcagcaatgggctctggtcacgtgctagtttacgcgtttgatgtctttttacagctgtatgagtcagaaggttattcaaagagagacgctaccgaaaatattattcagtataatctgtatggttttgacattgatactcgagcattccaactatcatactttgctttatctatgaaagcgcgcgaatataatcggcgtttcttaacattgggattaagtccaaacgtttttgatatcccagaatatacagatttgtcggtacaggattttgaagatttaattactacggaccagcagtcttcagatatcacgcgtttattaaacgcctttcatgatggcaatagttacggctccttaatgcattttactgaccccattgattttctcgaaattgaatcaattattgatacaaaacccggagaacatcaattatcttttgaaagtattgaattagaagagaaaaaacataagctaaaagaaattattacagtctcgaaacttttatgtcgcaaatatacagtaggggtcatgaacccaccatacatgggttcaggaaaaatgaatgatgttcttagtaaatacgtaaaacgacattttactgctggaaaagcagatttgtttgctgccttcatggaacgactgcgaatgtttgtgagtgccaatggctactatgcgatgattacacaacatgcatggatgtttctctctagcttcgagaagcttagacaatcgttaacacaagatacactaattaatatggctcatttaggaactcgagcatttgaagaaatcggtggcgaagttgtgcaatcgacagcttttgtgctgaaaaagcaaaacttaactgaatacgtgggcacgtatgaacgtctaattgattttaattctcaagataggaaagaggcggcatacttagcagccgttcgagatcaaacggtagactacctttatcgaactaatcaagcgaacttgtttaattgcttgttaataatgtctatctgactttatttgtggtctacgggacggctaggatttaaataacaccctagtctagcccaaccccaccctggaactaaatcaaactcaagccattatataaactatgcaccactaaattaaggcgcaagtcgtgttgccgctggtataagcaagctaagatcaaaccagccccaaaatacagtaaccaacttagactgagccgcatttcatggacgctcgcaaaagccccggcactaacaatggcttgccatctttgatgttgtcccaaaaaccagcgacaaaataagcctcgaaacaacaattcctccatcagcggcgcaataatgaccaattgaccgatcaaccagccttgacgccacccgtgcaaactaatcaaccaggcggttaaaacttgttgattagcggtagtagcctgcccaccacggtgcatactggtcatcataataaggctaagccccaacagactaactaaagcccagccaccattaattagaaccggtcgccaataatcaatggggcgccaccaggcctgacgactaccataacccaggcctaacgccaaaaccattaacaccagtgtgccactaccaagtaagaaaatggtggcgcccgcggacctagcttgcagccccgttaagcacactccggttgcccattgttcaattaggattaatcccaaccagccccctactttgaccactaactgcatctcaccgcccccgttcttgttgggcttgttcaatcgcttgttgctggttaaacaatgcatttttggcctttaaatcttgataatgggtctgttcggctcgccgcaattgctgtttcacttgttgcccctcttgctttaagatttggtgactagcctgttgctgttggcgttgaaattgctttaaatgtcgcggcttccagtggttgacagccgtcttcattggctcccaaccggcccttgccggcgcttttttgtcccgcttgattttggcgctgagtcgttcaatttttttataccgttgttgcactacggccggcggtaaagcttccttatagctagccagtgtggctttcaacctcaataattcctgttgttgtctagtgatggcttgaagctgcgcgcgcatctggcttggcttggttaatttaacacctagttcctcacttaacgcttgttggagttctggtcggagctttgaccagttcaccccactaacgacgctaccaccattaagtcgatgttccgcagccaatcgttgttgcatctgggccacccgctcggaagttaattgcgtgatgggcacatttacgacgtccgtgaaataagccgttaaatcttgtaactgttgccgttctgtagggctttgttcccatggagcttgtagcttcaatttagcgagcgttaatcgttgctgatatcggtcacttaaaaagggacgggcctcccgttcggccgcattgggtggcacggatttctgactcagtttcgttaactcccgctgagcttgttgcaccttgccctgactagctcgagcattttgctgtcgcaaggccatgcgccgttgccgcagttccttagtcttggccggggttggctgtagccgatttgcttgccgtaaagcatcgatccgttgacggttggcttcaatatcggccgtggtaaagtttttggctagtccggcaatggttagttcagtttcattgtctggtagctcgcgacaagctttgaagagcgcattggtgagtcgttctcgcagttcggcttctttatgtgccagtgtccgcccagccgtccgttgaccaaaggcggctgcattgtactgatctagggcctgcaccgtttgctgaaaggcttggaactcgggattgccatgcaaatattgattgaccaggtcaatcgctagctgtttgggtttcgccatatcacgagcattacttcgagaccaccatcgttttttatcggctggcagactggccaagagggcctgcagctgttgttcaccaacggtctgactcagttgttggtgcagactagctcgttgaacccctaaccgcttttccaaattcaatttgcgtgttttagcctgcggtcgttccaaagcaattaagtcctgaaaaatatgacttttgatactccgaatggacggttgggtaaattttcgccgcgcttctttcgcaacgcgtttaccgttccgataaccaattttatctggtcgtgggcttaactccgaaatacctagatgcacatgaatatgggccgtattaaattgaatatcaccccaccaaaatcccttttcggctaacccattagctttcaagagtgggcccatactgtgacgcaccgccgctttgatcttctgctgatcacaggcttcagtcttagggtcatacaagtgattgtcaatcaaatattgcgttgaaaatgagataaccccggcccataaaacgcctttattcgcctgggcggtgtctaatttttgccgtaattgatccgtctcggccaccgttaagtgatcggttcgttggtcaaaggtgggcgttaattgttgctgcttgggcttggcaacctcgtcaccttgatctaactcagtcgccgtattgcgcgccgtataatcaataaatttttgataaggcaagcgcgttgccactccctctaccggctcaactggttcctcatcagggcgctgactagttggcgctaactcagctaaattgtctcgttccagttgatctaatcgctgttgtactaaattaacatcattgcttaaatctgttgcgttatcacgttctgtgtatttcgtatacccactgtagctcattttattggccaccgtcgcggcggtaaaatattgcaacctaaagacgactgctggctgctggtgttcaattggtttcgacataatgctgtacataccagtccttccactgtttaaattcagtccgattaatctttaaataattacggttgaccattaacaagtcgcaaatttctttctcagtaaactcaaagtaagccagtcgtgcggcctgttttaaaatgggcacgcgctcggttgcgaggacttgatcattagcggcaaattcggtaaacggcactggtcgaatcttaactaagatctgatacagctcacgttcccgagcaattcgcggccagtcttctgcaccaacttgttgtcgatacgtggcatcgtcaacgacaaacttttctgcatcattatcataggcgccaatttccacggcccacttatggtcagccgtatcaaagctcgataattgcgctaacacatttagaaactcgtcggacaaatgccaattttttttgctagcggtcttgaattgattaactaacatgtccgtccctcccacttttagtgttgccgtaactgattggcttgaatatcagtttcaatcatcttttgcacttgttgtatcgccatattattatccgaaccgggcgtataaattgacccaccctccgtcacaactccggccgtaagattataaatcgacaataacagatacttgatttcggcttcattttgccgatttaaccgcaactgcttatcaattttctggttcattggtgactcctgcacgcgtttcaatagttcagcttcgcgcccataaaatgatttttgccctaagttcgtgtaaagaaacagttgaataaattcgctgataatgaagttatacattttattttctgtacgcacgagccgagccaaatcaggatcactttcacagtaagctttaagttcggcaacccgtttttgattataagtatccaaccgtaaattgattttgcgacctcgttgcttgctactatcggcaatctggtcattgtaatctagtggattttcgttagccatttcaataatctcccttcaccatggtcgtcaataaattcttaatctcggtcaattcattggtattcaaattagtaacttccacgactcgattcatcagggccgtttgttcaattaaatggttcgtaatattcccatcaatgaggaaatccaaattatcctgcgccaccacttcattaatgatggtgcgcataaaatcagaaagattatcataacccgctaacttacccaatcgttttaatttatctttatcagcttgcgaaacattagtcactttaatgacagttttatccattataagaacctcccatagttccaaaagtctaacgttaaaaattccaaaccataccggccaacacaacgaaatctaagatttctgcttttagcggtttagagtgccaagacgaaatttttaatttctgtggtactagctaaagagcataagagaaactagaccctgccgattaaaaaatcgtcatggtcccccgcagtgcgggggtttctatagggacctgcgtttgctcgttttttgacgttttggccaccaaatagccaccgcttgaccgccttttgaccaccagataaccaccgtttgaccacttttaagaacttagtttttgtgcgttatttgggtacttttagtgaccttagcgagcttaaaagtgccattttttatcgcggcttgtttcttttttagtaaggcttgttccgctgctaacgtcctaatgtgctgtttagcactcctgatattttgttgattttgttcaatatctccggttaaagtttcaatatcattgtccgtttgggtctgttgactagcgacttcatacttacgattcgttcgcttcgtttggatcttatcgtggtccgcactaatggttgtcttggcaagtttaattttgttttgttgccgcttaatgctagtatttagcgccgaaatttcatcattaatggtctgactggcaaaggcttttggcgataaagctgaaacctgggcctgtctaattttcgcctgattcgtcacaataaagtcagcttgtggccttgatgaactcgtttgatctgtcttaggcgtggcattaatcaaccggaaccgaatcgcttcaaagttctgctttaaatgatcaaccatcacgacatacttgttttcggtgactggaatcacgaccatttttagtttttgtggcaccactgtcgctaactcaaaatgtaaatattgcgacagaatttccgtggtggggtccgttgacgcctgcacttcaaacgtcgcaattaggcgttgttgggtcgggctatactggcgttggactagcttgacaccttgtgcgctgttgtcaccactaaagctctgataactgttcaacggcgtatcatcattcttagccgtttggcgattgaacaggccataattaataattaacccaccggttaaaaccaggtaaagtccgataatgaaaaaccggcgtagccggctatgttcttttaaataccgccacccggtagttagttttttcatcattcaatctcctttgcagggttaatttgcagtcaataagtgtttaattttggttaagttcgttccttgataccgagtgacttgaccgtgatcgtagcggattaaagtgggcgtttgggtgactttaaattgcgttaagtaccgtcggttttcagccttttgggtattaatattgacaatctgtagcttctgaccgaaatagtttttgaactcacttcgtaacacttgcggcgctatttggcgacaatcccgacaccccggttggtaaaataacaacaccgcttgggtctttttcgataaccgttgccgcacaacttgcgtgacagtcggcgtttgactgggccgaattaaacgctcgggttgccaataaaaccagctcactatcccgaccatcacgaggactaaactaactgataaacctttcaaccaccagtgcttgttagtcatacttgtcccgccattagttgttccaatttaaattgggcgactaatttttttaacggtttaacgggccattcaatacggccaacgacggtcggccgccgactagttaacgcatcagtagtcactggcacttgcttaacaatcccaatttgaatcgcatcattactgggacacccaattaagacaacatcattgggcttcaatttaattgactggtttaacgcactatcatattgcaccaccagtggttctgagagccgatctagtttaataagttgaaccgttaaagcaactttcattcctcaattgcccccaatctaacaatccgtaacgggtgggttaagacgcgtaagctttggcgttgaccacccaaataatggccacggttgttttccgtatcaaccaaactaggaaagttggccaacaaccattgttgggctaatcctcgcgtggcaaatacttttccttgaactaaatccccggcagttgtatctaaaataccgtactgactcatcttataacgtcccccttttcactaattggcagtgcttagctaaggtccaatcattgtggcctttcgcattatgcacaatatttacagtcgtgccattttccaaatgttgttcgattagctggcccacttgtggcgcttctgacactttagtgttcccattcgtagcccgcggtttgtatgtcacccaatcccctaaatggatcgttttagccatcattgttcttcactccaaggattttgttccagtccggcttctaaccgttgcacgttatgcgccatcttatcttttaaccgtaataaggctagaatggcattgtcataggcatcaatcttggtaaagtcactgcgctcgaccacttcacttaaccgatcagccgcgtcaatggcggcctgaaccagttgattaaattgccgatttaactcgttgttggccattaacaacgtttgttggtgtttcaattgttcgattttctcagtcatctgtttatatttttcactggtttccgcgtattgatcccgttcttccctaagcgcttcaatctcgcgatcaccttcggcattaacttcttccagcagctgatttttagtcgctaaaagcttagtctgcttctttagatcttcgtaatcatcaggcactgtcggtactgggatttccacttcacgaatcccttcagccttaatccgttgtaatcgagcttcatacttatcctttaaagctgcttgttctgcggagtgttggtcgtctttagcttttaactgcttttttagttcacgcaattcacgaacagtcatttcatcaggggtcttttcctcacctgactccaaacgatgcaacttttggcgttcttcttcgggcaatgtggcaatttgatatagggcttccactcccaaatgttgcgacgtcgcaacatttgattctcctaatccatcaactattttcactgctctatttgcaaaagtcttgttaacacctactgatttcaaccatttctcatactcaccatgcgctaagtcattttctttaacccacttcaatcggcgaccaatttcaaagattgactggcctgcaattgactgataactcttaatctccgtcgtaatttgggttaaatccgttgataaagcttggtcactaggtgtctccaccacttgttgggtaatatcttttcgctccatttactggccctccttattttttaaagctcatgtgaaggcaacaaaaaagggagcaactggtttcccagttgttcccttatgtatctactatttcctcagtcagcgccagaataacataactaacaaaaaatttagtctttaaaccttgcaaccgcaacgctataccgtgacgatgtccaatagtctaaagaaaatcgaccccaaaggcctacctcctgctcattttatgctaaaattagcaccgttgctgctgaaacttagtagtaacataagagagcaagtaggaaacatagacaagttatgcttcttacgtcgaatcatgctaaagcccggactggtaatccaggaccagtgattcccaagctctcttttttgatgcccacacatcaacaaaaattcaaaataggttcttaaattccagctgtaggttgtacacatcacaaacaagaacatatgttcttgtttgcgactttaatttatcacttctttaataagacgtcaatactaacactcatttatcaataccagcaatcttgataccagattcattttcagaatcaaaggttactatcccttgatttttggtaatccgctgtactaacagtgtcttaactttattagtcgtaccagcaatctgttctgaaacaatataccctatgaatttatgatcactaattaaatcagactgaatcggcttaattaggtcataacgtacagttccaccattaaattgtttactagtaaatgttatgctctcctttaaaattttctttttatttttagtcttttggtagattgttttatttctttctagtccttaatccgtcttgctgattaaactatcaatggccgtaacctgctgcttagcgccgtcataggtgacttcataaacacttgtcccggcgttccaagttttagtgctggcatatttgctcttatacttcgcaaccactaagacctttaactgaacgccactaactgcttggcgataaacccgtaattgccttagttttgaggtgacttggctcccatcaccgtataattggctcttgccgccaaaatactgttggtttagcttgggcgctaaccagtgcttaactttcgcttgccgctgttggtaagtatcttgattataattatataaaacatggaacaccgtcgtaatatttgcgaccatagtcgcgttactagtttgaaccgtctgattatcggcactattgtttttaactcgctcttgggccttaaccgccgcctgtttggcttgattggccgccacgacggtgccctttaagtgggcctgcttctttaataaggccgccctttggcgcttaacctgactaatttcagtggtcttagcttgcacctgtcggtactcatgaccaccccaaattaacgcgccagccgtaactaatcccaagaatacgatgataactgttttgtgttccatatcctgactcctttactttgctttgatggcccgggcaaatgtcgtctcccctgataataagctactaaaagccgtgccaaactgcgcaatgttaatgcttttaccagtgcccccactttcaataattcgggtctgattgccatgccagtcttccgttagaatggccgtatggccgttattaccactaccttcaccctggttcacaataacaatatcgcccgctttcgcttcacttttatcaatggctttcaaataatgatgcgccccagtggcatcactcgccattgtcccggtaaaccaccccatgttagcgggcactttataaccagccttatttaacacgagccacacaaaacctgaacagtcggttccaccggatttattaggattctttaagtccttccccaagtctgaactcgggtgcgtctggacataatagaaataccccaaccaacccttggctgttttgagaatatcaccatcattctcactagtcgcgtcacaactactcccagttgtttcatcactagcggtcgctaacccatcactcgtgcccggatcagtatcacctaatttggccagccaatgatccgctaatggataccgccctggttgccctgacggtcccttctccaagaaccactgttcgggattattgcgcataccttcatattccatcaaccaatcatacgcggcttggtgcgcgctggtttccttaaaaatatgtttcgcaccttgatagccatgcgccatctcgtagaccataaagttcaattgggcatctaaggagttccattttttattatttttagccgcaaagctcatgaggttatcgtagcggttactcatccactgggcgaggcccgtagcccccgaaccgcccgtattcttaacgctcggatttaattgtgattcaaactgccaaacacccaagataccggctgcggcttgtggggtcgctttaacatctttgttcgtccgtaagaactgataaatcgtcttagcattcttattcatatcagcgctggtcaccacattactgctagtctcagtggtcaccgcacaatcattgtcatcatcactactggcaataaatgtaatgagtagtaacagacagctgatcaagaggagtggcacgcctaaacctagactggccataataactttcttttgcatttatccgagccaccacctcattaccaaaatcaccaccaccaatgcaaaaattaaccctattggtaaaattaacttatcctgaatttgcagcgggttttgggtttgacttaaccgtttcagttccgcgatccgggcttgccgggcctgttgccgtaacgccttgcgttgcgcccgagttggcttgtctgacttgggttgccttttcatatttagcccaccccgccatcataacgatctagcatggctggtgaagcctgcaccgtaaagacatagttgccattgccttcaatgtgcataaaacattcatgctcacctaactgggccaccgtggccagttcttccggtgtgattgctttaccaaaagcttgttgtaaccggggtaaatcatcagcggtcaaccgaaagaaaatgggataagtaaataacccaaacatctttttcatcgccgtatcatacttctgataccgctcactcggcacgatacttttgctatcacccaacatttccttgatcgttggcatcactagattcaacccacagaagttcttgcgcatttcttccatcaggttcgttaaccaagcgaccccttccgcaaactcggacttcgcatagttttgaaattcatcaatattcaaccaataatagggcacatcttctaacgccactgcgtggttgttatacaaggtgcgatattttttcccattattgatgatgtcagccgacaataaactcaaagctgaatagacttgcgcgttaaaggtcgctgaaccattatttttcagacctgaacaatcaaagaccaccgctttaatcttagaaaaatttggaattgtggtaataccattgaagatgtcaccgtctttcgtcatcatattttcaaacgtattaacgatgcgattaatcgacgtaatctcaacgtccggccgccgcgtaatttgatagttgtcttgtacttgccgtaaatagaccacaaactcccctaaagtcgggtattgatcatggggtaacccaatcgcgtacaacttatcccggttttccgatgggttggccacccacatcttttgcatgatataaaactcagtcgttaagttctgtaaccgaatccggtcatcgttggtcaagtccaggttttgtaagcaagccatactactgatcttttcgatatggtgattaaacgagccaatttcatcaatcgcttggctgtctttcgtcgtagccgttggaaagatttcaaacgggttaatccgattctcactcccgtctagcgagatcacgagtcctccttgggagcgacattgcttggcatactcgttggcaacatcaaaagtccgggtaaatcccccgcgggcaaaggcgatgtcattcaacattttagctaacacggatttaccagaaccagggcgtcccgcttccatgaaaaacgacgttaagcggttctgcccgacataaaagggatcaagcatgattttgccctgggtcttcgaacaacccaagtacaccccgtggggatcatcaagttcgatatgattgaacggaaagccatggccgatgacacttgcggctactggtgtgccttgccggtgattatccaataagctttgcttctcggcgggcacatataagcttctaaactccgcttcttgttcgccatagaacacccgcaccccaaagtcatcaggcatatcttcggtaatcttagtcaaccgctgacgcaattggacttcattatcggcatagacaaagacgcgaatacttaaccgtttcatcttttcagcgtgtaataaatcccgtaacagcgcggcttgtttctgattggcctcatcggcttccatacgtgcaatcggctttgcatttaaatcgcgagcctgtgagttagtttccgccactgagttttgtaaagctttgcgaatctttcgttgatcctcagtacctaaactaatcgacgtcaccgtaaaatcatatttcataaacttgcgtaaccaaaaataggctaagcgttctttgggaaacttaaaaacgtgcaagcacgccacacaactgccgccaaagacgaggtgactatctaaagtcgtatccacatttccctgcggctgggtatgcgctaacagtgccaaatcatagcccgcggcttgtaattgtttaactctacgtctagttaacatggcctccaggcctcctttatattttcttgtcgttcatattattgagactgtataaaaacttaattttgcgatccaagcctaacggttcaaaccgcaaataatggccttgtcgttgaaataacgtcgccactcgttcggtcaactccgctggggtatccccaaaaatcaaggctaagtattcttggcttttcaaggttttctcaaccgccgtcgcaatttgtaagctttcattgatataccgtaaccgcgttgttaacatttgccgttgttgatcgtcatgacaattgactagggcttgttcaacttttaaataatcatggttcaaactcagctgttgttgcgcggtggtcgctggaaattgggtcgcaataaagctccaatcaggatcataacgttgtaaaaattcggtaaactcttgtgtcggttgacttaaaacattatctggcagtgccgttagtcctaccccaggaatccggcaaatttcggcgtagccccaatcgtgcgccaaaactaaatagtggtagtcatcattggtaaagcctttgtaaccaagcagttgttccacactgcgccattttttaaattgtttactcggtttcacttgggcttgctcaacttggcgcgcctgccctaacggggtaatcggtttaaccgcgccgttgcttgttttgcgcattttgttttaaccctccaatcgttaataacgcactgagtgaatcaaactcgtaatacgaatagctgtggtagtagtgaccgcccattagcagatcattaatcactaactggtaatttttcttacctgggttgtgatacggtgtgatgactaaccaaaccgcaaaaaccagattaattccttgaaacagccaattaatcccagctcgactgtctggaaacactaagttagcgataatcatcgccaccccacaccaaacgagcactaagacaatatcggcgacgtaaaacaagaagaccttcatacgggccttcacgtccggcgtcaccccgacattgggcatattattctgattcatcaacctgtctcctttctttgaatagccttagcttacctagtgctttgatcatgggtgcactactaccttgacgacccaaataagcgcacaaaaaagcgcgcccccggtaaggaacgcgctaaccaaggccgtgatggtactcaccatcactagcctagttgaatacaggttgatttgtttgcgaggtaggttactaccaccattaatagccggtaagccattaacaattgttataatacgtccttcctctgataatcgcaaccttagtaaatcgagtcatcaatcttaatttcgggtaagttaaccatactttgcttatccccaccctgttcacgggcaacagtcgttaacactgtaccagccttggttaaggtcttacccgctgcgcgcttggacccattggacactactggttgtctacctgatgctgacttaacctcgtgcgagctttggggctgtgcagtggtacggtcacttggggcgccatcattcactgatctagattgatgatcacccggccattcaggttgctcatcaacaggacgctcaaagacctctcgctcatcctcctcatagtccgaaatgacgccttccggaatgacacctttgtttgcttgatcaccatatgctggttgtgacattggttcgctagcaccatcttcacgggctaagccttctggacgatccgctgaactgacctctgccccaactgtcggtgtactctgatcaccgctactaggaactgttactcctgaagttggattaggtcgtggttgtgtcccatttaagccaccttccgcttcatgatcccaactggccggttccgcactagtaccgttcgatgccgtcacacccgcagttgggtctggcaaagtgttaagttcgtctgatgtttgaccggcttcttttgctagtccagttgtcccattatctgatgacgccgaggaagctggcatcacgccggcagtcggatctggtaagccatcaacagttttagcttgggaaccagtttctttatctaaagtcgttggatcaggcaatccctcatcacttgttggctttgttaattccggcgtcggttgatctgaaccactagctgatgaactggcacttccagcggctgagtctgatggactgaccgtggaagccgactgaacatcaatttgtgagctaattccgtcaggggccgctgcagaatcggcccctgcgttttgggtggctaagccgccgtgcggtgccaagttcgcttgatcagctatggtatcatctcgttcagctgcacccatagcattcggtttaactgttgcttgaccggcttgttgggcacccactttggtgggatctggtaacgcgctcgttccagtggcgctatccaacgctttattgacttttccggcatggccttgcatgtctgaacctgctttactcaaaccagctgcaccggctttaattcctttagcagcagccgtaatccccaaacctaagcccatcaaagcgcctagcgccgtccggttcttcgattgtggtaccccggtccaacgttcaatcagactaactccggacataaacgccacaaaacaagacagatacataagtactaagaaaaagccaatcggcaacgccgaatttggatattgttttagaaaagctacgcccggattatcggctgaccccagataatctaaggcaattagaaacagccgtaagccaatcatttcagcgaatatcccgataaacgagccttggattgcttgcaagacttcttttaaccgttgattggtacgtaaatcttgaaaccccatcagtggcgctgaagcattgagcatcaaaatttcaaaccacgatttgccaacgcgaaaggcaattaacccaaacatacaagcaagcaataagagttgtaaatcggcgataacgaaatggccagtataacgtggataaaccgactcaaaggccttggttaactgactttgcttgcttggcaaggtggcgtcctcaaccgtatattgattcgtttccgcccccatttttacccgatgcttaaagacattatcaacacccttaggaatcaaattcgtttttaaattatccgacgcaataacttctgaaaggtccaaataaccaatgttgtccgcattaatcccgttatatttgtccatttgaccatctaatttctccggattaacgtcaaacccttttttggctagggctactgaatcgacaatactattctgaaccggttgtactgcaatgctggttacaccactgccattattaccaacaatatcttgggcaccggccgtcacgaattgactaaacaagttagtcccaaacggcaacattactaagattgcaatcaccaccaccaagttcgtaatcacttcatgtagtttcgtctttgcccgaaaaatattctcaaccagcaaataacctaacccaatcgttaaaagcgcgaatcctaataacacgatggtcttataaagggtgcccatttcaccaacattaaaattagcaaaaaagccaaacagttttaaaaccgccataaacacactctctaaggcttgcgccgtatgatacaggcctaataaaatccacccattaaccgtcccaataatcttctgaaccgctaaaatatccgtgtgtaacacattatgccattctaaataaaactttattactctagccgtattagtcccttctccacctccaaaaagcttatcaattaactgattattattaagcaatgcttcgggcacttgatacccggacgctagtaccactaaccactgaaaaaatgttgtcataaccaaacctctctcactttcgatttacagttagcttacctactgctcatcaaaagcgagcaacactactcaactgatattggccgaatattcccggcttaaaacccgcctaggcggagtagcttgaatcgtgatcatgcgtctcacgtgaggagttagttctaaacggtttggaggcgacgggacgactaataactaaataacaccctaatctagcccagttaacacccagcaggcctgcccagtccccaaccaaaaaacccgtgtccagaactatagatacgtaatggcattttagaacactaaattctaacccgtatctagcaaattcaattgggcattgcgatgatgatcttggcgagcatcaaggctcaattgttgtagcgccactaattcttctgagggttctagtaaccgagcaaccgttatccaatagtttaatcgctgttggcgttgtaacctcatcgcatgttgtaacaagctactacgagtcgcaaacttcgttgcttgccgaccgctacctttttcacgataaactaagccttgatcaattagatctttcagggccttggttagactacctaagcaaatatttaattcttgggaaatgtgccgtaaagacgttttggtaaaccaattattgtcccggaaaattctttggttaaagtaagccataagatctgcttgccattcatggacatgactattaacgcgttctgaacgtggcttcgcatacttgtaccaggtcgtttgcgaacgctgcaaataaactcgcctgtcagcatcgggaacccaagtttctagcaacgcattcacatattcacgactggccgcatggaactgacctgaataagcatcattaattactttttgaacgtgctgtgtcgccagcgggtgggtaagattactgttaaactcgtccaaaatgtcaaaacactgggcttgtaacacgtttgaagaataacaagctaaggccagcgtgaagattgtattgtgccgaccatagcccacgttttgatcaatgtccgtttggttaattaaggcttgaaaccacggttggtcaatctggcgactagtccgccaagccttaaaagaccgttgagtagtttgggacttaatttggtgctggtcattcgcaaaattaatactccaagtcattaaagcttggaagtcaaccgtcattttaggctcaaaatattcaatattgtctggtcgcggaactctaaaaacgccaaagctgttgcaagtcacatcaaccgccggcaacttttgcgcgtagtattgctttaatgacttagcaatcgctttagccgcacgtactgccggcaatttcccattagcatgacgacggacgaacactggctcatcaaagacataatagatatgatagcccttggtagtcgccaaaattaaggttggcagaaactgtacgtctaccatcgccgtgtcccaaacctcggcaaacttcgcttgccgttcctcagcatcacggtagtcaacgtcaaccactaacgtattgatctgacttaaattttgttccttagccccttttacataatgcttagtcgcatctgtataggtaagataattaaaaacattgggcgtccaatgcgtgctagtcgcataattatcatggactgcttctttggaggtataaatcgtcccccagcttttcgccatttgggctttactgcgatacatggcaatcgcaccctgcttgttgtgcttccctggaatcgatgcttctaactgcaagacgttactatgccggactttagtttcccgtaacccttgatgcaaaatcaaatcaatcgcttgttgtgctgttttcgtcgttgacatactgctcaccccctactaaaaaagaacgccgtagcgttcttagtcatcatttttatgtattaaaattaaacgttcaaacactagatttttaagcaatcgctccagttaacgtggctacttggtatttaaaccccaacttggctcttagggcggtcaaattcatcaaactgcacccttgccaaacgtaaccggcacgagtacaattaactcattcttcgtagttctatgagttcccgtgattagcctcacggggattttttgtttatttaatttttaattgggattagcttaacaggtttcaacaaacatgaagcacttctccctttaggcttaatcaaacaaaaagcagattaagccacccactggggtaacttaatctgctttaactaaacctatgtatgcgtttaactcgacttttcgactggcataatcctaataggtttagtataatatccctatcaggcaactagagttgactacttttagtagttcatatcctagctagccatctataaagacgagcgttaaaggcgatcaagtatcccggtacttggtttgctggttcaaaaattattggagtaatttttgaaccaacgctttttttttatgttacttattttccatgtcttgaatatacaatacttttcattgtttgtaaacacttatttagcacaagtatactattgctaatgtagtatacttgtgcactaatccccaaatccactagtgtaaaagtggatttttgtaaaagtatatttttacattagtatactttttcatttgtgcttgatatatcgttatactgctgtataattggtttgttagcaaaagtatacttatgaggagtgttgaatgtgacaaaagtcattgcactgagtaaccaaaaaggtggtgtaggtaagtccacaaacaatgttatgtttgccattacagtcgcaaaattatttaataaaaaagttctccacattgatatggacttacaggccaacagtactttcatgctaagcttgacatttgaccaaacaacttggccggcatcaataactaaatgccttgatgacaaggacttagaagagggcattgtacacctcacagacaatttagatgcaatcgcaggtgataaagattttcgtaattggggtacatggttagctgacaacgtcaaaggtactcacaatcgaacgttttatttcaaacctctattagataaaattaaggatcggtacgactatgtttttattgacactccaccggccactgatattaaagtagacaatatcatggttgccacagattatgtggtagttgtacaagagactaaaaggtttgctttcgaagggtcaaaagatttgacaagttcatacttacaaaccttgtataatgatttcaatgatgaaattaatatacaagttgccggaattctcctagtacttcttgacaaaaatcattctgttgaacaacgaattgtcaaaaaaacgaccgaatattttggcaaagagaatatatttggtcaaataattaaaaaccatttgcgtttagaaaactatggcgaatatggtgtacagttcaacgactggcatgatagtagaatgttggcattgttctctgatcttttccaggaattggaagaaagaattgaacaatttgaaaaatacggtgatattaagcctggctatcgatatgcgcctaaatatgtgattaacaatcgtctgacaactttaggcaagaaggagttgaaaccaaatggccttgattaaaaaagatgccgacgctttacatgtaaacgtagaaaaaaccgttgatgacacccggaaacagaaaactattacagctaaggatagaaaaagccttcgtgttgatccagatacttatgacacgattaagagtctggcatatatcaaagataaaaagatatatgaaattgagaatgaaatggttgaagcctataagcgaaataagctttctccacgcgaaagagaaatatttgatagtatgaatagatcagccaaatagaaaagtacattagtatacttttctattagtatactaatgtacttttaagttgtagtttctgatcttatttagttttaagtttttaaagtacacaagtatacttttccattagtagaagagtatacttgtgtactttaaaaacttaatttagttgtaataatgcaatattttacaataagcggtgctgtttaattagcagctccgcttattatttttaaaaatcaatctaaatatgctctacgaaaaatctaactcaatcatggactcttccataccgtcaagaacctcattttcgttgataaatttaagccacttctctgctggcgtaaatcgattagctttcacttgagtatgcagtttcccatacaagttctcgacgacctgcgcatacattttctcagcctgacgagtgatctgttcttcattccagcgtttagctggctggcgtttcttgttcttactattgagatacaccagggctttttgcataaagatagcttccacttggctgttatcactgataaatttttgtagttgaactgtgttcatttaaacgcccccatagataatttctgtcaatttatacatttattatatcacttttgtgaacacatgttccccattgtggtaaaataaacgtaaattattgagaaggtgagcttatgttttttgatcaagaaccgcatggtgtgttctttttaattgataacaagtccttttatagcagctgtgaagccgtttcccgtggtcttaatcctttaaaagtcccactagtcgttcttagtgaagctgaaaacaccaatggtgggctcatcttagccacttcacccgaggctaagcagttatttcatcttaaagccaatgtctcccgcaaacgtgacttgcccaatgaccctagactctgggtcgtgccgccgcgcatgaatctctatattcaacgcaatttgcaaattaatcatatttttcatcaatttgcgagtgaaaaagaggtttggccctattcaattgatgaaagtattttggatatgacccattcatggcggctttttggcaattctatccgtgaagtggcgcggttaattcaaaaaacgatccgccaacagctcggtttatacaccactgtgggtattggcgacaatccggtgcaagccaaactagccctagataactacgctaaacacaatcatgaattgattggtgaaatccattatgaaactgtgccggctaagatttggtcaattaacgaattaacggacgtttggggcattggcccccgtatggcgaaacgtttgaaccgccttcaaattcacaatatgtatgagttagcccatgctaacccttatttactccaacagagcctcggggtgattgggagccaattgtttgccacggcctggggcgttgaccggacccggttaactgaaccaatcaaaactaaggaagctagtcttggtaactcacaagttctcccgcgtgactacttgacacaaaacgagattgaaacagtcattaaagagcttggtgaacaagttgcggcacggcttcgtcaccaccataaactagcagggtgtttatcactaagcattggtttttcttatgctgcggctgaaaccgatggccgcagtggctttcaccaggctttgaaaattgaaccgactaatgataaccaagctttaacgcaacaattattgtggttatttcataagaactgggacggccaagctgtccgtaatattggcgtttatagtagtaagctcagtcctgacaccgggcagcaacttaatttattcgaatccccgcttaaccaaattcagcatagtaagctaaaccaagttattgatgaaattcaccggcgctttggcttcaccaaactcgtctatgccaccagtctattgcccggtggtaccgctattgaacgtgctgctttggtcgggggtcataatggaggaaatagttatgaataaagatttagatattatcacgagtcgcttagccttgttgtttaaaccgactagtcggacccgttattggctagtagttgccaatgacccgtacgatcacacttacaacgtgtttttcaacagtcagcgagctaatgagcgactacggtcaatgcctttacacaaactcactaattataatctcaatgacttagaaaacttactaaaggcgttgcgacaacagactaaattaacgattgaatttattggctttacgggtcaagtttggccgcaaagtcaaaaaattattcaaaagaggcggcaggggcttgaatgaaaaggattttgacctcggcattgttaaccgcttctttgagcacgattaccacgatcgtggcctaatgaaatggcaaggcttttacttatctgatcacactgccgctttaagccaacagaagatccaagataaacaacaatatccacccaagccacaacagtctttaagtatcgttggtcaaatactgttaacagcttacacccagaaccaaccagtcaacttacaattaaacaccgttgatcataataatcaacactttgcgaccatcacaaccccaatactgggctataatggggctactattgtgattgccaaccaccaatttatcaatattaatgatattcagcacatcgaattagtgcgctcaactaactggactggcaatcaataaagaccaccaaggcgctaatgacgaacctcggtggtcttttaataaatgctgacgcataacaactaataattgccgtttatcagactggtcactaatgaagcaaaaacaaacatatataggacaaagataactatggcgataatgaattggaccaatcccgctcggttccaagtcgcttgcacggccttgaatgtctcgacatcttgataatcacctttttgccaggcccattcattccccttaaagccaaccacaaaaacccaaacgatattaaaaattggaattaacgttaataacggcaaataggttttattgccaatgccccaaaaaatactgtacataaatgcgccccaattccaccctttgaccgcttgtggcacttctttaccattttctttcatcattacgttcccccttaatattagcttaccaaacctaagctggcttgtatactgacctagtatacgttatcgtgatattgtattacgtcgagcagctttaactgggcctagattcaagcctcgacgtcttgcttcacgatgagccaactgcaagctattattcaccttagcaatttgttcaggatttaccgttttttgtagtcgctttagtccattaacttgttgttttaacccgtcgtttgtgagatgctcattcacaaaccgctgcgtcttatcagtaagtttcgttgctaacttcggtccaactacgttttcaatcgttatttcattttcgttcaaagatctggtcaatagatctttcaggtcgtctttctcaacataatcttctgcgccaccttcgtaaaaggtatcaccctctttcgtccgataggctgaatattcatgtcccacttcatcatagtcgtagaattgagcaaactcagccttagacgcaatctctttaacgaaaggggcctgactaggcttaattttttctattactgtcggtgtctcaatcaatccttcgttcatttcttgtaaactactaactggccgatatttttcttccgttttatttagacttttatccatagcactatcagaatacttcaccacgtacccgctctgataaatgagatggctaatgattttctcttgcacttttggctgatctaaatcccccacaatgtctgtatgtccatacgggccattgctatcatattgggttaattgccaatccacacctgttctagcgctttttgtcaaagtaatacgagtatgattatctaggccttttacttcgaatccacggcctctgctacgctcaaatacacctttccaataatcttttttctgctgaacaatttgtccactcgcagccaaacccatttcaggtttccatactggaaattccgggacaatctcttgtcttaactcttcattttgtggtcgccccatactcttctcaagctgcaacctctgcaccagatgattactaatttcgattgtcttactactaacttgttgaatctcactgagcgcttgatgaatcaccgtttgatctttagcccaggtcgcgacataacctaatgagtaagcgcccgtatcaataccgatattttgcatggccacataagccacagcctctgcctgtgcttcctgatagccgcgcggtcgatctttaaaagttgacgttagtccatgtaattgactatgggcatattcatgatacaacgtctttagtcgcataccttgatccgactcctgactatcaatcacaatttcattggttttgggagcaaaataaccccgagcttgattttcagtcattggtcgctccgttacagttaaatctgtcgttttgttaaggtagttcttaaaggcttgataaagcggcgtcacattcgcgtgttctcctagctccgttttgataaaatcttgcgtttgcggtatctgcttaccggtagtgtgacgcacatcaaagaccggtaaataccgataacccacgatggcctggtcgcgtttagttcctaattgcctttgttgttctggtgtcaaccgtttagtaatgggcgccgcaatccgaatggctttagcacctttagttacctgacggctaaaatctttttgccattgtttaaaccccgccacttgagttgcctggggatcttgggcataaatcaaattaatattgcgtaagctatagtggtggaacttggccatcgtctttaaatagtccttaaaattcgcactagtcgttaatgattggagcttaacttcagcctgatgaacgagctgttgcttccaagcttgaatttcagctcgacttttacttgccatctacaatgcctcctgatctggaaattccgtttgaccatcaagccggactaagtcatcgtcgctaccgtataacgggacaaaagtacccgttgtactcttaatccaagcgacttgccgatatttcccttgaccaccaacttcatctaaatatttcaaatcgtccttcgtcatcaataccggtagttcactaccagctacaatcgttttatcagttgtcataccgtcagctccttattattgataggccaagcctagcaactccggcaaaacaacgatgacatctaccaacaaaaataagatcactaacctaccggtcagtgatcttactgattaatgattacggctagctcgcccttcgactaacacatttttcgtataacgttaaatggaccaatacatagctagcaacttcatcttctgccaagttcctaatttcaacatatgctgatgactgatagtcaacacaagccattaactgtttttgcaaggcgccccaatccttctcttgcgccaattgctttctgatttgttccttagcggttatggctagttcagttggttctggtacagaactagttgatttatcattgaccaactgaatcatttgttgcagctcacttgcagcctcattaccagcatagtcatactgtaatgtagtcaagtctaagcgcttatgcggcgtttcaactgctatgtcgaaaatggtggcgttatcgtcaaatgtttggttcaagaattgccaacgggccggcatacgagtccgccccgtatcaaagattggattagccctaatgattcggcctttttgatcagttcgagccgttgagcgaatcaccaccatctcacccactcttagtcgtagtaattcttccattgaaataactggcaccgcatctaagctactattgaggccattcaagtcagccacactgccttgtaactggtgccccataacattgacggtcgtgtggcccacttcatcactaatttcttgggcggtttccttatcttttgacaaaatatacaacgtattcccacagttactaataatggtttccgcttcttctttggagtaattaatccgtagttgccccttattttggagcacccaatcaaacaataattccgaccctaagccaatagtaaactttgtatctaaattttgaatttttggcaaattacccccttcgtcaataataaagtgcacgcgggtatagcactttttctcattatctagggccatttgatacatttgattgaaagcctgatcgatagcaaatgaaaccagttgattataggacgggttgtggggtggcgttcctaagaaaacggctactggttgttccgaatacttaaaaataattggttgttggccgtcggtggccatgatcacggacttttcctgattcaaaattaagtcaccagctcgcttagtggttgttttggctaacggcgaccgtttagtggtcttaatccgaccttgatagttatactgataccgccttaaagctggttctgtcagttcatgattaaaatcaatcgttaattgatagtttgaaggtaaaatggtcttaatcggaaatgtcaaaaagcctaagcgatcaaccatttgcgcgcgactttccaaagattcacctttttgattggcaaaggtcacctgagcagtttgtaaggctaattgctgtggaaaaccaattcttagacgccgtggaaaggccatatcatgaaaatctaatgagttcatcgacgttaaccgggcaatatcgcgttgttgatagattttaatgccttccatcattgaagcataaatattgccagccgtttcatcacccgcaaagtttgattgttgaaacgcttctaacgccatttcttggagtggcgttttaactttaatttgccccatagctttgaagtaatatgacaacttagtggtcttcgagccatcgtcgaattgaatttcttgcccacctaattcggttaactcccgataaatattattcattgttacccgttcccacgtttgatgccgggcagccaaatcaagttggctgagaatcagcgcgtttaacaagttagttgatgaattattccaaaatttactgttgccactgtcatcatggctctgataaatcgctgatgaaatccggttggcttcttgttgggcttcatcgtaatagccctgtcgtgcataatcaacaacaatcgctagtgggttataggccattgatttagccatgttttgcatatttaacacatagacccgatacccgcgttgttttaataaccgttccgacatggtaaatagttcgagtttgggatcattaatcatcattgacgacttttttttagcccgtgataaattatcaatcagtggtaaaacgattgtttcacccttcccggaacgcgtaatcccataaattaagctatgcactgtcgtttggtcaatcccataagtgccactcggtttgaaatcccactttttagccattgtttgctttaattttttgaatccccgactataacttgcactttgaatcaaggccccaatgggcccgttataatgcactagtggcataccaccataaccttcaaattcctgattacgatccggtatcaattcatattgcttttttagttgtcccgggctactaaaagtttccgcgcccttttcaaaaccattataactttggtaagaccggataatccgataccagcttaaacttaacgcaataacacctaacaaaagcccccaaattaaccaaggattattaaactgattaccaggccaggctttcgtccaatccaatactcgcgaccaagttaatcctaagttcgtgggatcttgaaaggcttgaccgtgttgcaccaaccccttaaaccatagtttcaggccttgtaacaataaataggctagccacgttgcataactaaagaacgcgagtgttaccgctgaaactaatcctagaaaaccaaccactgccttgatattacgcgcccaccagggtgcattattttgtcgtcgccgatttaagccttgaccaatacttttgatgcccataattctaccgcctttcactgcgtttcagttggtggccattgattttagggtgcgtttagtagcccgctaagcgcaccctaaaatcaacggtaacgtttcaataccccattagcatacttactgcgcctaccaaccgcgcaaagcgcccacaaaaaaagcgtccttccaaagaagcacaccacttaataactattctggatcaattgtttaaactcagcctcaccaatgattttaatttcatgggtcaaggcccaagttaatttatgcgtcgttggaggttcaaacaatcctttgtcaatcacccccgccaccaataacgtcactgccgatgaacagtagttcagcacgcgaccgccagcagcaagcactaattgttgcgcctcacttcgcgtataacctgttaaagtacccgtaaacaacacacattctctactcaaatctaaaattttcagctttgtttgcatcatgtcggcctcctgatcagcattatacctactctgcttgcaaagacaccttttagccctagcaagtaacactagctaatatatagcaaaacagaaaatataagtgaggtttttaaattgaaaaacaacaattttactgtcgatggcactgttagaagcatcactgttactagacaagttagcgtatttaatggaaaaacattaccaactcgagaagctagtttaaaattagtcgtaaataatgattgcaattgtgttatgagcaacagtgcctttcacatctggctagatagagcgccatggtcagcgttatataaatcagatcaagatatacttaaactggttaacaaatctgttcagttgcaaggatactttgatgtaaccactggaaatgagccagatttaacattagaaatcactaaagttattcttttggcaagtccatcaagttaattgttttctgatctaatggattaggtgataaagttattgcaaaaatagatttcttcagacttcacaatgcctcgtccccaaaattttctttaatcttactttgttgatttttaatcctgaaagaatacctatggggcatttcttgttgggaccaatatactcgttggcataatagcgagaaaatttcaaaagcacataaaaatctaatttttaagtgcttttatagtatccacaagttgatgactatttaacaactttaaccaaaggcactcacaaaaaatgaattactttaaagataggattgaacgtaaaatatcaaaatagtatttgcactttcatgttcgcaaacttgacataggcgctgtacaaagatctatccaactaagggtaaaaacagtaacctcctgagttggagtaaagccaaactcaggaggtttgttttaaagttaggcttggaaaagatttttttgttatttggttaaaaatgctatactttgaaacagaagaaaggagaactatatgacccctaatgaaacttatagctttttagattcttgtcgtctcttacccccacagatatatttttggaagccttttactaaaacgaccatttatgttgacactgcacaaagatctttgttataccatgtagacttgtacgatatgaccatttcaatttttgctggtgatcggcgttcagaattatctgaacattttattcctgttcgaaccattgatttgacttcagcccaaactaaaatgctgaagtcttatgaatatgtagagaatgtgacccattagtcacaaaatgacgaatggaaataactacatagttattgctagtcgtcatttaggatttagtcaacttcatttaaagactagatatcattgaattagcacctgctaatgatatctagtctttattaatattatcgttattcttgcaaataatagcagtcgcatagacgtactctacaaaatcattttctaaacctagtattaatgacatcatagtatcaattctttaaattctgatagttggatggcaactgttataagccgtaatacatagtttctgtatctataattttaatttaagactcgaaaagtatgtctttgtttgttctttagcatccattgttctgccttgatagtgtgttggtgtttccattgatgttgatgaatcaattttgacctttgtttaggatgattaatcattattatctcctactcctcattttagtgttcttcataaatactattatttataaagagtggactactacagatctttgaaagcttttaacttaaaagctcacaatatatataaacagccatcgaattatcaatcagatactcattcttcttatcatcagttattgaaatatttggtagtactgtatttttactattaacggtcaatatttgtccgagatgcaaaccagaatgctgaaaataatgaattgtagcgggtgtttctaaaaaactaataattttaacttctttcccgactggtattgataataaggatagcaaagttgggtgctgatatttggaaaaagcttctaactttaaagcacctccaaatgggctcgttttgggataagccatttgttgatttaacttggccattactacagaactatcgatagctgacattagccaagcttgcctgggaacctctggtagtgataattgaatattatcagcgagccaaatctcgcatagacggtaacgatacatcagatctgtaactagctgatagccctgtttcgttaacttaatctggcctttatttttaacaactaatttttgtaaaattaatcgattaaccgcctcagtaactgatcccggcaacacgcttaacattgttgcaagttgcttgttacaagtccatctttgcgtatagctagtttcatatatagcttttaaataagtattagttcttgatttcattttattcacctacaagcggaataattttaagcgtgcctaaaaaaatgtttaaatacgctgacttttattgtacaataacaaaggcttaaatgttagccgatttgtagaaaggtggagatttagttgagcaaggaagacaaggggagcgtcaaaaagcataagttaatagaatatgctaacggtccttcgctagaagaaattaatggcacaattgaagttcccaaaaatatgagcttttggaaaactttatttgcatattcagggcctggtgcattagttgccgtgggctatatggaccccggtaattggtcaacttcaatcactggtggacaaaattttcaatacctactaatgtctgtcatcttgatgtcaagtttgattgcgatgcttttacaatacatggcagctaaacttggtatcgtgagtcagatggatttggcccaagccattcgtgcccggactagcaagtcattaggggttgtcctatggattttaaccgaattggccattatggctacggatattgccgaagttatcggggccgcaattgccttatatctcctgttcaatattccattagttattgcagttttcgtaactgttttagatgttctagttttgctattattaactaaaattggtttccgaaaaattgaagccattgttgtttgcttaattattgtgatcttagcagttttcgtctatcaagtggccttatcaaatccagattggggcggcgtaattaaaggccttgtccctactgccgatactttttcaggttctaaatcagttgctggtatgacacccttatcaggtgctttaggtattattggagcaaccgttatgccccataacctgtacttgcattcggccgtatcacaaacacggaaagttgaccatgatgatgaggaggatattgctcgaacagtcaagttttccgcttgggattcaaacattcaattatcctttgcttttgttgttaactcattgttattaatcatgggggttgctgttttcaagaccggagctgtcaaggatccttcattcttcggattgtatcaagctctatctaatacttctatgttaagtaatggcgttttgattgcagttgccaaatctggtatcttatctgtcctattcgcagtggcattattagcttctgggcaaaattccactatcacgggtacattaactggacaagtaatcatggaaggctttgtacacatgcgtatgccgctttggttacgccgtctagtaacccggttaatttcagttattcctgttttgatctgtgttgtccttactagcgggaaaagtgctattgctgaacatactgccttaaataatttaatgaataactcccaagtattcttggcatttgcccttccattttccatgttgccattactaatgatgacaaatagtgaagtagaaatgggccaacgttttaaaaattcactatgggtcaaggttttagggtggttctcagttattgcgctgaccttgttgaaccttaaaggactaccggactcaattctaggtttcttcggagataatccgtcagctgctgaacagagtctttcctccattattgctaatattctgattattgcaattttagccctattagcatggaccatttatgatttatatcgcggtaataaacgttacgctgctaagcttgcggctcatcaaactgagagtgaggctaaataatgagtacagcttttaagagaatcctagtaggtgttgatgattctgctgatgctaaattagcttttaagcatgccattaaccaagcaattcaagatgaagcagaattagttattgtttctgttttggaaaaagatgatatgaacgtgtatcaagctttaagtaaagacttcgttcacggcgagcgaactgagcttgaaaagcatatcttagaataccaaaaagaagctcaagccgctggtgtcaagaatgtacgagccttggtagctgaaggtgaacctggtgaagtcattgtgaaagatattattccacacgtagaaccagatgttttaattattggctctgaagccaagcggggcattcgacgtcattttggtagtcaagcagcttacatggctaaatactcaccaatttcggtactagttatccgataatgtattaagactgcgtattatcagagtttataagctctaataatacgcagtcttttaatatcgctaggcaaagtttaaaattaagattagtaaaatttgaatttcttattaattgtttcacactatttacagtaactatcaactgttatgaaacacattttagcgcctaaaatacgttgaacatcaaatagtacaagctaatattattttgaaaatatgttcctatttagaaactaagtcttataattaacatagagtaactaactctttatcaaaatacccacaaggggcctgctcaactaataattgagcgggcctcttatggttcatatcgattcctatagcaactaatattaataaatagctagtataaataatgccaccaatttcaaaatcaatttttctcaaaactaattaaaccaagcgacaatcctcttagtgagtgattatttaagtgttcatttttaggctaatttaaaccatcttaagtaagttaggctctatctttttcaattcttagcgcacctattttttagttaacaattagcttaatccgtcgctgttgcgtacgtttactaatccccgtctttcgttcaatcatcttataagtcatcctctgttttcgtaactcataagcaaatctgatttgttcatcagaatacgttttcggtcacccttcccgaaacaacggatcatgttgcttggcatacaatttaccttcttgcgtgcgcgtgacaataatattgcgttcaagctgcgcaaaagcactaaatattgtaaagactaattgtccagtcggcgtattatcaattaagcccatattcaaaatgttgactttgacattttctttaaacaactcttggataatggctaatgcctcgcgcgtattccgtgcaaaccgatccaacttagtgacaatcaaagtatcgcctgtttttagaacgcgcaacagtttttgaaactccggtcgttcagtagttgtgccggtaaacttttcttgaaagattttttctgctcctgccaattttagtaactcaatttgatttgctaatttttgatcagtggtactgacccgcgcatagccatatttcatctttttatctccttacttatgtcattaagtaatgacacggttctaaccctttaattatacagtatcaaaaaataggccacaactgttaagttatgacacttctctctactatttattctttcttgtgacgtttcactaggtttagtcctaaatttgaacaattatactggacacctatctttcttaatataactcgaaacaaaaacggccactagggtataccctaatggccgtttgatatgaacttattttgttttatatttatcttgaacagcaagaatttttgttaaatattccatatctaaatcttttcccaaggagtcttgataatctgtttcaacgacaaattccttcactgtgccactcatggtctgatatatgaaataaatataaacggggtttttattaacgaagcgctttaatgctttataattagacgtaagacgattcttaactgcgtctaaaaagcgccctttaggaataacaatagttctcatttcgtgacttttgatgggaataaaaccagtcgccgcaatttcatcgccattttggatattcaccatttgaaggtaaggatataagtccttatcttcatattgctttttatagttcttagactttatcttatctataaggcaaattctataattaatccgaacagaaattaaaaagcccaaagcaatcacttacaatggtagtagctaattccaaccaatatagagagtgattactttgggtacatctactttatcacgttttcaacgtggcgcactagcacaactggtcaatgaggggaataaatcttaccaagtaatggctgacgccttaggcgtcgccaaagctacgattagctatgagttggaccgggttaaaccttatgatccagaattagctcagcaagatgcagatcgcaaaaggcggaattgcggtcgtcgttcgatgctgacggcagcattagcgactttaattaccaatcacttacgattaacctggtcaccagaaaccattgcggccgcttataacttgagcactgcgtcaatttataattggcttaatcgtggctggctccccttcaaattgactgacctacccaatcggaatgtccgccagcaccgagtgagcgaaaatcgtgggaaattcacaagtgggacttccatcgaacaacggccaacaactgttaatcaacggttagcttttggtcattgggaagtagatacggtgctttctagtcgaggtgagtcacgatcatgtctggttacattcgtagaacgtaagacccgacttctatgggccatcaaagcccctaatagaacggctaaggctctaaacaccgcctttggcaagtttatgggggccttcggtccccaagtaaaatccattactgttgatcatggtaaagagtttgccaattatcaggccttagaacaggattatcagatcaaagtttatttttgccatccttattcaccatgggagcgaggttccaatgaatattttaatagacggttacgctggttcttcccgaaaaagaccaattttagccaagtaacgactgatgagatcctagcagcacttgaactaattaatcaacgaccattaaaaatacatcatcaacagactgccattgaaagattccgggcttgttcggattaaacttgtaatttgccatgaaaaaaattttagttgcttgtggttccggaatcgctacctctaccgtcgcccggaataaattagaagaagatttacaagatcgtggcatcaacatgagccaaatctcaatgaatcaaacttccattcctcaaattccttcaatggtatcagaatacgacgtaattgttaccaccgcacgctataaggaagatgttggtgtaccggtaattaacggcctttccttcttaaccggaattggtgaagacgctgctgttgataaaatcgtcgaagccttagaaatgtaacttctactatataattaacttgatttttgcttacttacaagtatttattaatatgataggaaaggaaccacatggaacgccaataagataataacaattcccattccaacgcttaatttatcagttttacccgtctgtttcttactaacaaacccggcaaataataagaaaacgccaattatcaatgcaaatatcgtttgattcatgctaatttcctttccttataaaattatattatttcagaatacctaaccagtaacccagaatacctacaccgaataaggcaaaaataagaataattgggttaacttttttacgtaaaaagtacatcattaacaacgttaaacccaatgctggtaaacctgggcatagttggtctaagatcgtttgaaccgtggtaacaacttcttttccaccgctctgagttctggaaacaaccagtggaatattaatggtcgtccacttagtgactaacacccccatgacaaacaacccgaggaccgtagcaccttctgtcaatttaggtaataagttaccagaaacgtctttaactaatgctaacccacgattcaggcctagttttaatccataccatttaagtgctaaccgaatcgcattaaaggcaaagaagaagataaacggacccatccaagagcctttaacggctaacgaagcacccaacgcagctaagatcggtcgtaaagtcccccacataacgggatccccaacaccggctaacggccccattaaaccaaccttgaaactctgaatcgtcccagagtcaatatcttcaccttgtgctttaccttgttccaacgccatagtaaccccaacaattggaccacatacaccaggtgtaacgttgaaaaacgttaaatgccgttgtaaggcttcggcctgatcactctttttatcataaacccggcgaatagtgggaatcatgtcgacacagaatgctaaaccgtgaattgtttcgtagttaaacgatgcttgttgaaagttttcaaatacgaaggtttgaaaaatatcacgcttggttaattggttgacaatttcttctgctgaactcatcttattcacccctctaatcgtctaattcgtcttctggcaattcatcttccgatgttccggatgaagaaactgcactgacaactggcttactaaactttggatttaactgaacatagactaaggctaaaattagtccaacaccaccgaatgccaacaggcttaatttcaagtatccacccaagataaaacctaaatagaagaacggcattaagtacttaacactcatcatattcataaccattgcgtacccaacaaccacgataaaaccaccagcaaccgtcaagccacctgttacaacgtctggtaaagcatttagcatcgcttgaaccatgtaagggcttacaaaaatagcaaccaacgttgttggaatggagacccgtaatgcttgcacaaataatgccgaaaaatgcaaccactcaatcgttgtaaacttggcctccttagcagctcggttagcagcatgttgaaaagcaacggtaatcgtccgtgcaaaaacagttaaaacttgaccagccgccgcaacgggtaacgcaattgcaatccccttttgaatactttgactaccaacgataaccaggatcgttgaaatcgtacttgccagcgcggaatcaggagattgtgcagccccaatgttcatccaccccaaggcaattaattccaaggtcccacctaaaatgattcctttcactggatcgccaagaatcaaccccatgacactacatgcaattaaggggcgatgtgtttgaaattcatcaagaacacttccggcaccagtaattgaagaccaaataaaaattaaaaccaattgaaaaattgtgattttcattttttatttacctcacttatttgtcaaaagtttcattgatttttttaatcatgtccgtgtgtggatcggttttaattacttgcaagtcaagctttacacctaatttatctaacgcacggaaagaatcaacatctttttgatccaacgagactgacttagtaatttgcgttcgtccctcagaaaactgcatcccaccaatgtttaaagtgtccaacttaacgccaccttgtaccaattccagtgcttccgttggattggtaaataggtaaaacactttatcattagcatacttaggattattgaaaacagcgattgctttttgaacatccacgatattaaccttcatgccaggagggcaagcctgcttcaatagggtcttacgaatcgtatccttgtagacttctccactaacaataataatccgatcagcaccggactcctttgaccaaacggttgtaacttgaccatggattaagcggtcatcaattcttgctaacgtaacaatcattagaattcatcctcctcttcggcttgctcctgattaacaacactgagtactttggtatacgaagcactattatcactaaggtattgcactagtttttcaacagacattgtattcatttgggccgcggattcaagacaaattggtaatgacataccggcaactacatcggcgacttttccttccaaagcaagtgttgcggcagcattgtagggcgtcccagagaaaagatcggcgataatcaacgtatcctgactgtcaaaatttgtaatgacaccttctaacttcttggttaaatcctgcaacccttcttttggtaaaaaagctactggatagaaatctggtaccttaccaaaaatcatttcaacggcacccttcatcgcttcagcagtgtgcccgtgtccaatcaacacgattttcattgtctttcatcccctaacctaattagccccgcgacttaccgccggcgacattgatggtaacccctgtgatgtagcttgcacggtctgacagtaagtagttaaccaaatcagcaacttcacttaactttccagaccgacccattggtgtcgtactggtactcttataacccgcgcgtaacgtgtctaccgtaatatttcgggtatacgctagtgcgttttcatacgaaggtgtccgtaagccagtagcttccataattcctggtgctacacccacaactcgaacattgctggatcctaattccttagcccatgaacgagtaaaaccgttaattgcacccttggttgctgagtaagcactttgaccttgagagccttccaagccagcttctgaagacatattaacgatgacacctttaccgtttttaactaatacgtgtcccactgcctgtgacattaaaaattgacttttaacattgatggtaaacatcttatcaaactcattttcgtccaattcgtactgaccgttggcctctttcgtatctaccaacaaccgtggcaggttaatgcccgcgttattgactaaaccgtcaatgttgccaaattcgtcaatcgttttattaaccagtttattaatttgatcccgactagttacatccgtttgaacaaataataggtgatcgtttttgtaatcgttttcttttaagtccgcatcaacaacgttagcaccattagcaattaattcatggacaattgccgcgccaatccccgatgaaccacccgttacaatataagttttatccgttaatccaagccattccataatgtttcctccattcacaaatgtgttattacatcaagttattcatttcacttgctatactagcaccactatcagctttttcaagccctcaaaacatttatgcacaattgtgatagctataaatatctcaatagctatccgtaaccattagagctacaatactcctagtaaaacattctagggagggctcggcatgtcaaaatttgacgttgaaaaaattaaccaactaattaaaatatctcagttatattacgaaagcggattaaatcaaacggaaatttccaaacaagttcacgtgcatcgcacagaaattagtcgattgttaaaagaagcacggtcactcggaattgttaaagtcagtatcgatacttcatttggggccagtgaaaacctttctaacgaactgcaagaatactttagcttaaaaaaggctattgtcgttcccaccgaacctcatagcctatacgcaaacgatctaaagtcaatcggaacttacgctggaaactatatccaaaaacaagttttttcaaactgcatcatcgggctttcctggggaagaacactcgccactacctttgacaatctcagcccgatcaagcacgcttcgggcaccactatcgtaccaatgatcggcggccccatcggagccttagacgttaattatcaagcgaataatttagttcatacgctagctagcaaagtaaaaaattctgcttcttacacacttgacgctcccgtaatgttaagcaatccttccttacgtgatgagttgttagctagcccaaacagcaaagacgtcatcaatttttggcgccaaatggatatcgcaattttcggaatcggtagttcagaaatcaccaataatttagcttggcgtggcttttatgaaggcactgggtttcgtgatgttttcagtggtccaaccgttggggacgttttatcacagccctttaccgtcaatggtcaagtcgttaaaaaattcaataaaaatttaattgcaacggaattagaagatctcaaaaaagttccactcagaatcgcaattgtagccggagaaaacaaagcagaagccattctaggggctctcaggctccagcttcctagtgtattaatcacaactgacaaaactgcaatcgccataaaaaagttaattcattagcataaaagcatcttctcacaaatgtgagaatatgtttttatgcattgactatcctcctgtccaaatgtactatcagcactgtaaacgaaatcaaaaacttttttcacatttgtgaggaggaacaatgatgaatagtattggcttacgtattcacgggaaaaaagatatgcgggtagaagaatttgagcttcccgaaatcaaagatgatgaaattttagcaactgttgtgagtgacaccatgtgtatgtcttcttggaaattggcccaagagggtgaagatcacaagaaaactcctgacaacttagacgcgaatcctgcgttagtcggtcacgaattttctggtaagattttaaaagtcggttctaagtgggctgatcagtaccacgctggtgacgattacgttgttcagcctaatttagcacgggacgacaccccattcgttcccggctactcttatccatatattggtggcgatgccactgctatcattattcccaaagaagtcatggaattaaactgcttggttccgttccacggacaagcctactatgaaggctcactctgcgaaccgcttagttgtgttattgcggcctttgaagcacagttccatctaattccgcatacttataaccataaaatgggcatcaaacctaacggtaatattttaatgctcggcggaactggtccaatgggattattagctattgattacgccttacactccgatgtaaaaccaaagaacctcgtagttacagatattgatcaaagcaagctcgaccgtgctaagaagctttacccatccgacgaagttaacgtgtcattcgtaaatgtaaacgatttatccgtcgacgaacaaaaggcgcttttaaagaaaacggttggtggcgaaggttttgacgacattttctgcatgattagtgttcccgccctggttacaatgtcaggtgaattactaaatcctgacggttgcctgaaccagtttgcgggtccaattcataaggacttcgctgcacagttaaacttctacgacgtgcactacaactttactcacgttgctggtacttctggtggaaatgctgaaaatgaagcaaccgccgctaagctaattgcggatcgtaaagtaaacgttgctaaagttattacccacgttttaggtttaaatgctgccggtgaaaccacgttaaatcaaccagaaattggtggtggtaagaaactggtttattcacaaaagaagttcgatcgtattgaactagctaaagttgattctaactctgaactgggtaagattttagctaaacacgacggcatctggtcacccgaagctgaacaatggattttaaagaatatgcccgatatttcggaagctgatattgaaaataaatagtttaacctaaacaagtcccggaacgaattctcagtacacatttgttccgggacttgttatatgatgtctgtataactgtaaccagctattcgaaggtagcgtcaagaatcttgtgtaaatgaaatgccttcgtacatataatatgtatctaacttaaataaatgatgcttccaaggtgtcctggagtcctttgaaccctcggtggatccgcttcagagacttctcgttataaacattaaactgagaaaccaggaagtgtaaccttggtggaccgcaaatctcggtatttattatctcagcgggttcccaaagtaaacgccaagaacgtcacacaagcgatgattgacctcttgcataccgtgacgcccaaacgagttcggacgcttacgccggatcgtggaactgaattcgcaggataccgcgaagttagtcaagagctaagtatcccagtctatttcccagatcctcatgcgcctcagcaacggggaaccaatgagaataccaacggacttatccgtgagtatttccccaaaggaaccgacctagaccaactgactgatcaagatatcgacaagtttgtcagggatttaaatcaccgaccacgtaaggtcttaggctggaagagtccatttgaagttttcttcgggacaaagttgcgcttgatttgacaattcgtcgtaaaaaacgtagcgaattcacctgtaatagaactattatcgatggacttatggtatttttttacatttgacgtcctaagacatcaattattaagaataattttggaactttacgtttgatacattggttccgactaatgctaaacaataattatttagcttaaatgttctggattttacaaactgtcctctttttttcaaaggatcaataattaaaaaatggtttttagaaattggtttgattaaaaatgagtctaattttctttgtaatccaattccgatatattttaaataaccttcttttgaagtccaaatttgtgcgaatctgttacttataccagcaagatcttccgcagtgttaatataaaactgctcactttttctgaatagttttattacttcctcatagtttttaatgtattctaaatctaagccaaccggattatctgataaagctacaactacaacagatctagaatgactaatacttgtaaacagtggacaacttttcaaaactggagatcctaatatatcctgagtgaaaagatagtctttaatatttaactggcctaaaatctgatccaagatcaatcttgctaagatactttgttgcctgtggcctttgttcttcattgaattgaccttaacgtaattagcagaggatattttcccttgatcaagcagaagacgaaatttttgtgatagattagatgtggaataaatattcccactggtaatgtaggtaatgtgatttgagcgacaatttataaaagtattataagtcataactgttaccggccaatacattcatctcttgttgaaattgatttgctaatgccttgagattcttgccatcgctcatcatagtaaagtggtttccaggacagggtaatatctttaaatttccctgtgtgtacctttgccaggcatccccttttgttcttgacatcttggttagtttatatattttgattggcatgccaattgttgatgaaaataaaattatgtcagccttgattgcagaggtaggctgttgacctaatgcagaatggttgtctacccatatatcaaacagtttacgaattttattatcctctaaagaatcagacatcaagttttttctttttaataagctaataatttcattgaaggaatgattggaaaagttcattttcaatagtttttttgccgcttcattatttccggacataagagtccaagctaatggaaaaagcgattgataattttttattgaaattgtttttgatgaatatgcttccggaactaagctgtcaattagatatacttttggaaccttttgtttttctttttctaattgacgagctatttctacagctacattgccgccaaaagagtatcctcctataatgtaaggccctttcacttgaattttactaatctgtttaatatataaagaggcaagtttagatatcgataaattagtttttaaggactctggataggaaattgcgtaaacattaagtcctacatgctgcatatttttaatcaatgcatgaaagcagtacgtactgccacccgcaggatgaattaaaaataagttcttagcttgcgaaccagaataattaatttcctgaacattatcaaattgattatttttgtgttttccaataataaagtgcaacagtttgcttggagtaggattgtttattagttcactagtttcgacatttgaagaataaactttgtttactctttcaagcaagtcaatagcgattaacgaatctccatcaagatcaaagaagtcactattatcatgtacgttctttgtacctaacacttcattccaaagtgtgatcatttgtttaatgtcggcttctttatcatcgtaatttgttaaagaattttctttattgtgatctgattttaatggttgaagtagatacttatcctcgttgaagggttgtttaggtaggaaaataaaagcaccacttctttttactgatgttaagtcataatatttatcggcgaaccactcttgataggtagaacttccgaaaacttcagaagaaacaaaattatcattttctaacttttcaagtaaagtatttactgattctgcaataaacacttttttaatctcgtaatcacttctcccatagattagtgttttagaaacgtccttcaaactgatttgttcatgcctcttcagaaagtttatgaatctgtttatatattcttttagggccacttcattctttgatgataatgggataagatactcttggtagtcatccaagctatgcatctttttaccggattcaagtataatgtgcacatttgtccccccaataccaaacgaagaaactcctacataatgtgtcgttttaggatctaatggattgttaacctcattgttaatgaagaggtttgctttttcgaaattaatattgctatttgcagttttaaatccaacgcttttgggaataatattatgatgtaaaattaatgaacctttaattaatccaacgattcccgaagcagagtctaaatggccgatattagccttcacagatccaatctgacaagaacttttaagattatatgcctgagatagagcacgaatttcaatgggatcccctaaaggagtaccagtaccgtgagtttcaatatagtcaatttggttcgaatcaattttggaattctttattgcctctctaattgcacttcgttcaccatttatcgatggtgctgcataaccaaccttgcgattgccatcattattaacgccaattccatcaattattgagtagatgctatttttgtctcgtaatgcatcttccagtgatttaataacaatgactccacaaccatcgcctttgaccattccattggcagtatcatcgaagggtcgaattttaccggttgatgagaacggtgttccctcgttataaatatacccagaatttctcggataagttatactaacacctccagcaagtgcaatatcacagtgaccattttttaagctagagcatgctgcagaaatggcaaccatagatgaagaacacccactctgaacagtcagtgacggacctgttaaattaagcttataggaaactcttgtagcagcaaaatcgttctgatttccaataaaattagaataattaaacatatctgtccatttattgcttttcataacattatttaacaaataagaactaattgcagaggaaccaaaaactccgatgcgattaggggatttctgtggagagcatgccgcatcctctaaggcctcgtaacagcacttgagaaaaactcgttgctgaggatctattactttggcctcagatggcgacattttaaaaaaggaggcatcaatatagtcagcatcatcgaaagatgcagtaactgggacaaatttcttgtttcctgaaaaaggactttcagaaatttgcgtgtcattaagcttttcaatactgcatttacctaataacaagttattaaagaagtcgtcgatgttgttactacctggaaatctacctgacattccaataattgcatattttgtcataaaattatcctttctttaacttagcaatgtactttgcttgctctgcaggtgttgcatagtcgaaaagatcgatcatactcatttcatattggttcaaatcaaatttttccaggattttaatgtaaacttgcgtgattaagactgaggttcctcctgcttcaaaaaagttgtcatcattactgatatgatcattattaagcacttcataccaaatcgctcttatttgttcaagcgtactggatcttttgataattccagatttaatattgtggctacttgaattcataattttatcaggcaagggaagttttcttttattaacttttccattaacagtgagaggaaaaccatctagaaaaacataaaatgcgggaatcatataagtaggaagtttagtttttaagtactttatgataataccctcttcaatagatgattttgctgtataataaccaatcagtcttctgtcattctctccaaaatcgtgagcaattacacatgaatgaatatcacttctaagttgatcaaaagcattttctacttcacctatctctacacggtgaccactgatctgtacctgtttgtctattctggcaagatattgtatttcaccatttggcaacaccttgactaagtcacccgatttaaaggcataggaatttacactactcttaaacgcagttcgagttgcttctggattgtttaaatatccgcttgcaacctgattaccagttattattaattcccccttaaaaccaggaataacatcttgtccaaagttattttttactgagattacagtttgagataaggaatgaccaataatatttactcgtgagttcattacgtccttttcggtcactaagtgagcagtagaaacaactgcggcttctgttattccatatagattatagattttggaatcgctaaacccatacttctttgtccagggtttgagatcagagaatttaacatcttcaccgccaatcagtattagttttaatgattgtaattggtccggttgggtcatatcatattgttgcaatgagaggaaagatgacggtgtttgagttaaaatatttatgttgttttcttttataaaccttctgaattgatcagggtaaagttttgtctcttgagggacaatatggagagtcccacaatttgctaatgaaccaaaaatttcaaacattgaataatcaaaactgtaagaatgaaataaaacccagttggatttctgtggaacaggtaaagatgttctttgtgatgtgagcaaacttgataatgccacatgagatacaagtacacctttcggagtacctgttgacccagaagtaaatataatatatgctattttttctttttgttttgaaatcatttctcttctttggctggaatcctcgattaacttttggagtagtatatgattgtaagagtagaaaagatgatcattataatctgttataattaggctattacttatttgttttaagattaagttcttcctggattctggcattttcttatcaagggggacgtatatttttccagctttaaaaattgctagtattacttctagaagatgaacattaggctccaaagaaacgacgacgaatttttcattatacgttgataatgtatttgacattgaatctgagttttcatctaattgtaaatacgtgagggtactgttttcatcatttatagcaatttgattgggaaactttgcgacagagtgttcaaatctatccagtgcgctagaggattcctttttagcagagtaattactgttttcaaggtagaataggttttctttctgctcgtgtgataaaattgaatattctgatgttgaagtcagtctatttgcttgatatgcctttataatattttgaaaagacattgtaattagtcgtgcatctattgtatcttcagattgcacatgtatgataatatccttatctaagacttcaaactcaacagataatgggaacatggcatatctatgttcgattggaacaatactactgtctaatccagctagatcaaaatttatttcatgcttgtaaaaggtcactgaattgttcataaaaccaacattctttaaagacttgccgaataactctggtaagtgagtatttacatcaaatctttggtatttcagtatcctatgcaattgttggctggcatcatcacatactttagaaaatggttcatttttctccaatctaattattaatggtaagttgttaataaaacaaccgtgtgtttttttatcttcggaacgtctgtttgcgattggaattccagtaatgattgtctgtttaccggttaaatttgctagcagaattaaatagaaacttaataggacttcgaaaatgtctttttcatttttattggctattttctgaattaagtgtaatggaagcttgcaatctgaacgcttttcgtaaagcacttttttgctctctactccatttgccaatccctcttgactaaatgtgcttaaattaaaactattgattcgttccttaaaatatcctatagctcgttcttcacgacttttgttaattgtcttattaattgccttagatgattcaaactgtgagctgttttgaaaatacagatgccgattataaccatcatttatctctgtgaaaagttgataagcactgtaaacatcgcatatttcatgacttatatttaaaaacaggaagaactcgtctttaatatatttactttgataaattattgcttcttctaagggccatttgaagacatctaagggttgatttgcaagccgatacgtatctttaacaactgacttttcaaatatttctctgttttggtctatagtctttacttgaggaataaagtgtttactccaatctagattatttttaccatccttgatgaacatatgatatacgtcatgaatattaaatactttttctaaaacttttgataatttaggaacgtctaaatgtcctgacaatttccataaataaggtaagttgtatgaagcatcttcgggaaattccttttgatgcaataagattgaactctgcatgcatgtggtgttaaacattatttatcctccagtaatttgaatttataaccatatttccaagtggtatttgccgatctagattgttttctaactaccttgtttacttttttgccaattagatcattaatatcggtattcttgatatctatcacttctccaagaataaatgggccttcgcacagtttgataatacacatatatcttggtgatttttcccgatatccgaaaatagcaatttgaggaattttgtttgtaaccgcatttactacggttccggtcccagagaatttataattctttaaatttaatgaatggcagttcgggcaaacaaatcttggcggataataaagttcattacaactgtcgcaaacacttccttctaaccgaattagaccgccttgctctctccaatctttcaaagtcgattcaatcatggggttactaagctgttcagagtaattattcatacattatcgccttcctttatcgatgttttccaaaacgaaagctgctgtggtagcatatgcccccccaataacagtagataatccatattttgcatgtgggttaatttgttcccctgttgatcttccttgtagttgcttaacaatttcaatgatttggtataaacttgcgccaccagctgcatgacctctggcaacatttccaccatcagtattaattgggcatttactactgatgtctcctccgccatttagaatatattctggagcttttccgggagcacaaatgccgatcgcttcaagagaaagaaaagtgttaatcccttggtcatacagttcgataatgtctacgtctttttctgtaatgtgggcctcttggtatgctcgattaactgatatctttaatggcaatccttcgtaaagaccggaagcgttttttctagagacttgtttcaataaaaatggctcatacctatgagccatataatgagaggtgttgtctaaccctctgcctttaatgactacacgatcacctcctttatttttaacaactgaaagaataacagctgaagctccttcaccagcctgcattgcatttccaaaaaaaggcattttttctaattgcgtatcagtaggaacctccttaccataaaatgatgcgacagtattttgagatccatattgtcgacacattttccccatttttaaaaggcttttttttgctacaattgatgagattgaatactttctaaagtattcactttgaagtagaaaagaatctatatgagaaaagccaaggttatagtcatacatactatcagttgataaaagcatgtaattttcaaaaggcaaaacatctgtaaatttatcaaatcctgccacaagtacgtgcttataacgccctgtttcaatcatttcacaaccttgtattagtgccacatgtgcgctagcgcaattagccacgttaacaaatgctggaatggaggataaccctaaagcatcaactagtgttggacttatacctccatgaccaatctcgccttcccctgcataagaaaaacttgctccatcaacttcgtccgcatctatattagcgtctttaagagcatcataaactgcctccacaagtaattctttaaacgacttatcaatatgtgccgatcccggagctgcagtacaaccaatgccttctatttgtatactatttttcatttttcactcctataatcacaattttaaataaaagttcccaatgcaatttctggttgaacgtacttaaattcatatttcatggcttcatcgtaatttatatctttatagtgctgaataatccgtctagtatctgacactctttgatattcttttatggcatcagttactttaaatataattgaagttgatcctgaggaatggccataaccgcaaactaatattttatcgctaactttagccttatctaaagctaaagacagagatacaagaggagttgcactgccaatatctccagtatctttagtaaatactgacttagaatcccagccttgggtaatattacttatttgtacaagatgctggagagatgggttacctgaatgaggtaaagcaacgtagtcaatttcgcttctgtttagctttgcttcttttaaggccaaagaaatagactccttgcatcttgtaaccaatcctttattaattacatcactgtttagcggagctgttatcctgataaatctttcatcttctggtctagcttgctcaagaaaagtgtcattagaatgtccatacccaatgactgaagctattacatttctccctacccctaaaacacatgcagcagaaccagctcccatgtatggttcacgtaattcgctgggaaaaatgtgcctatttaaggtatcagaaccgatgcataaaacttctttatacatatcagactttaaaaatgaaattccggttagtagtgctgcaacccctgaatcctctgccgacttaatatcaaagccagtgtattgcttgttttccccatttaggaatgtcattacctgatttgcattactcctgaacaaatcaggaacggtacaacttcctagtaatattgcatcgagattatcactagaaacactcgccttttctaaggctcgtttggacgattctgcagacatggttaaaacatcttcatctgaagatattactgttcttcttgaaacatttatgacattctttataaactcaagtgaattatttttccatacactaatagtttgttccacaggcaatcgtaaaaatggaatagatactcctattgaaacaattccaacatcattaaacatcatctgtgcctccatataatgtattaatatttcgaactatcttggaaatttcatcatttcttttgttatcagatatcgttgtattatcttcaataattttttctttaactattaaaaagacaaactgtgtgataattccagttatgatttcctcagcattcactaaattggttaattcatgatttctttgatactcttcaataacatcaataaatgttggaacttctttatcagaaagcattttcaaaaaatcccgtttcatttggggattgaatagtaaacgagaaaaaaaaacttttagtgcattaaaatgttcccagacatattgatatctatcgttataaaacaatgttaaaaaatcagtaaaatttaagttattgttacttagaacttccgaagtaactctgtcaacttcagtaggtaaaatttggcttgcaattgggaaaattgcatcatgtaataactggcttttagtattgaaataacggaaaatcgttccctcagacacaaatgattttttggcaatctctttagtcgatacattctcatagcccttttcagagaacagcgttatggctgtgtctattattttcgcttttgtgttatcagctttagataatttttgagaaaacgttggattcatcttctttcgtttttgaagtgattactcacttttttataataaccccatcctcttttacttgcaatataaatttaaatatgccaaatttcaaattaaggtgtaccaaacgatcatgaatacctactggttgggataaccttaaaccaggccaaccaagaattttccaactaaattatgagcgaccacggagcttatccaaaactaatatacagacatttgtcgttacttttatcgccaatccatcataaatggtctccagaacaagctgcagattaaagttttagcacagtaactggaaaataaattatggtagattgcaaatttaatccgaatttttggacaaattggtcagcatgacctgataaggtgtttgccagttaagtattttaagcggtatctggttaatttgtagtaacgtcgtcgttaaatcttgagcactaatgtgctcaaaacaagtccctttaggataaaaataacgtaagttccgattaaatcgttcattactaccacgttcagctggagtataagcatggcagtaataggtcttaataccatatcgtgattcaagtgatactagaccactaaactcagtaccacgatccacagtaaagctgtgcacagggccattaaaagttgttagaaacttagttagtgcttcattaacagttgctgttgtccgatcttttaaccggtatgcccaaaggaaccgtgatttgcgatcgattaaagttaataaaactgccttactatgcccacgagggccaacgactgtatctagttcaaaatcaccgatgcgattacgttgattaaccaccataggacgctgttcaattgatcgtcccaatgattgattatatttggaccgttggcgtacgccatgttcaggtagatcattcaagggaaaatcaatttccccctgatttaaccaattgtaaatagattgagtcgctagtttaaattcgtgagcaatcatttctggtgaccagcttagacgtaaatggtttagaatggtttgctttaattcgtcactcagtttacacatcgtgatcgcttgtattcggcatctgtttgtgcaaattcagcctgataaggttgacatcgagataattcataagaaattgtggacggtgatcggttcagccaatcgctcatttggatattggacagccctagttcacaaaaggtttcgattttaattcgttcaaaataggttatactagacaaaagatcagctcctaaaagataggtttgtggtaaacaccattttagaggaagctgatcttttttgtccgaacagcgttcggattaattttacaattagcaagaattcattatcatctcagaaataccagtgttttcccagatccacacgtaccataacaacgcggtaccaacgtaaatattaacagcttaatttgcaaataccgtcctaaataaactgatttaaacgacctcaatgactaataaattatcgccttcattacatatttaaataactgtccactacaggtcttgggatggaaaagtccaaatgaagttttccttgataaaatgttgcgcttgatttgacgattcatcatatagaaattaattcaagactaaccttcagcaaacagatcacttagtatttttaataagttagaaatcaatcatgctctcccatctgaaaaatagtattattaattacttttgccaaattgtaatcatcatatgtactatcattagcgagacacccaacaaaaacattccaaagtcccccaacaataaaccatgttgcaactgcgatttctttattatttgatgtttttaaatgccataccataggaaaagattcatacaattgtggtatttttttgttatatatactcagcatattcgttaataaatctctctgttctaacaacttcaactgattcatattacctttccaaaagtcaaaaaacaattttatgaaattttcaaaatctcttggttcgtatttttttaaggtggttaagtagtcatttaataaattatcaaaataatcttgaagcaaatcctcttttgacttaaaaaaccggtagaaagttcgtctagaaattccagcattttgactaatgcctttaatagtcaattttgaatacggcattacttgcaataattcaaaaaatgaagcaatgatgctacttttagtttgtttagacattctattaggcatgtttttatctcctcgtatatttattaaatatattttctatcattatgtcacatatatgctggaatatgtcaagagttaagattgctaataatcgcttgtttttgctaataaagtcacctatagtaaaaacagcttttgacacaagtgtgacaattagataggagtgattttttgagtaaaattaacaaaatgattggtttttcgggattagttttggccatgtttatgggcgccctagatgctacaattgttaatatcgctttaccagatataatgaaaagttttaattctggactaactgaaacaacatgggtcgcaacaatttacgttttatctatggccgtgtttatgattactgctgcaaaaatagctgatatttgcggcagaaaacttattatcttaatcggggtactattatttggagcattttcttttgcctgtatgacagcatcttcattaaacttgctaattagttttcgttttattcaggggattggtggcgcaatattaacaccaattgttttaccaatgggaatagaactgtttggcaaagaaaataccagtaaagtgtctgcaattattggcgtttttagcgctcttgcagcagcaggtggaccagctttaggcggcgtaatattaaatttggcaagttggcgttggatatttggaatcaatgttccgatatcacttgttgcttttttagcaattattattggaactcaagaatcctacgatcatagtatttcaaaaaagattgactggcttggtatggcctttttaattgttaccatgggaagtttaacattcggcttattagaaggccatcagtacggctggacgtcaacaatcattattagttgctttgtaacatttgttattggtcttgctctatttattattactgaacattttgttggatctcctatcgttcctttaaatctatttagagaaactacatttactgcttccagtgttgcatatttagtttttggttttacaattattggaccatcgctgattctaaactattttttgcaaaatgttcgcaattattcggcccttcactcggcctacttaattattccagcttctttagcaatctcaatcagcatgccattagctacaaagatgtatcaaaaaattagtgctagattattaattggcatcggtttagtagtttctgcgggtggtttatttatgttgtcactacttagaacaaatacaccagcagccaatattgtggcatgtaacttaatcattggcataggtttgggatttacagcaatgtcttacacatcatcagttaaatttttacctgtaagtaaaaatggaatcgggtcaggaatcgtaaatgcagcacgttacgttggccaatgtcttggtatggcgattttagttactctgctgaatacgaatgttactaacgcaaaaagaaacgtacgtcacacagcctaccgtgaaattaatactgccgttctttcacctaacgtcaagaaaacggctcacaatgaagttaaaaaagtgtttaaatcaaatactaacaacaacactaaaatttctgatcaacaaagggaaatgaaacaacaaattaaaaatgctgcgaaaaaaacatcgcacttacctaatcctaaaactggaagtactttaaaaacgatctatactgccactaaaaagattcacagtggatcaaacaagttaaaccaagattatgcctcagtaatcaacaagtctcaacaattacttagtggcaaaccatcacttatattaaagggtgccagtcaaaaattgaatctagctagttacaaaataaactatgcccaagaaaaactaattactggaattcggttaattgctcagaaagagcaattaaccaaagttttaaaacatattaaaaatagtaaaaatcatcaattaagtttagctttcgataacgtttttattgttaatagtctagttgtgctattgtgcacacctttagcctattggacagataaaaaagaaaactagaaaagatgattaaatttatcagttggatccgtaatattatttttaagttgacttcttctaaacaaaataacccgatctcaacaatttttataggaaactggaggtatttaggtaaaaacaataaagaacataaggtaactatcactgacaatttagagttaattattgacagtcactccatttctaaaaatgtaatattaaccgaatcaaataggttagtattcctagatgcatttgggtttgaaattactttttttactaatagatcgtcttatcttttcttaattgatgaggcagatgatgaacagtacctattaaccaaattacattgatacacataaaagcttgctaatttcttaatgtaatcaaaattcaagtgtaccaatttatatatactatctattaatataaggggggaaataatttgaatctgtttactagcttttgggttctaccaatcctttttatcttacatgatttcgaagaaatgataattatgcctctttggaaagagaaacactttgacttgctctcccatatgcatcatccttactttgggagtgtaaccaatggtcaggcattttctataggtgtacttgaagaattgcttatattaattgccatctcaattatttgtggtatcaataataaccacgccctatacacgagctgtttaatcacttttgctatacactttcttaagcactttacaatgtgtatctctgcaaaaagttatgttccgggtataatttcatcaatcatggaaacaccatttgtagtatggttaattatccatagattgatgttaaaccaaattccgattttaaacatcttttataatttgattccggtatttatatttatgtacattaatttaaaaatcatgcacaaaataatgccaaagattcaaaataggcttttatcatacgctagaccttaggactatggaacttggtgcctctttgactaaaaatgctttttgtaattatcttaaaagttgcattttaagaaaaccagtttattcggttacgctagttcaaaaatttttgtctaagaatctgttcttaatttttaacaaagttgcaatagaaaactaatgaaggctaaagctaccgtgaatcggctaatttgtaagtgatattcgcagttacaccgtaggtaccggcacttgttcccccagcactgggggaaacattcatttgaatagaatcgcataagttactgataggttaaaacaattttttggtttattaaggggctataagtaaaaataattttttaaaaacatccccccaatatctatagctaagtggatccctaaggttgaacactaaagccaatcttaggggttttactatgactaaatttaatttagattttcgtataagggtcgttactgaatatttatctggtaaaggttcaacatctttagccagagcgtatagcattagcacgcattcaatcattctggattgggttcatcggtttgagtggcgaggtattaaagatctgaaaggtcggctaatgtctcaagaatagtctagtcagtttaaagtcgatgtattaaactggaagaaacaaaatcgagtttcgctgccagtgactgcattgcactttgacctatcatcaccaagtactacttggcaatgggaaagacgattcaagaaagctgggattgcgggacttgagcgaaaacaagggatttctaagcacatgaccaaacataaacagaacaagccccaacccgtgaaaacaccgaccccagccgcagagttgaaacatgagaatcacatggtaaaaattgaaaattaattcttaaaaaaactcgatgacttagcacagaagaaggcaaaacacacgaactcatcgaactagtagacgagttaaggccggagtttcaagctcccatcaaactagttcttaaagcggttcatattccttgcagtacatactattacgcgaaggaacatcgtggtagcgatttagatgattcacaaatcattcaggacattgacgagcttcgtcaacaagatccgaagtacacccgtaaatatggataccgatgaataattgatgttttacatgattacggttttaaaatcaatcacaagcaggtcttacgtatcatgcgggagcatgactggttatgtcgagcttttaatcgccagaagtgaaaatataatttttacaaaggaaccgttggggtgatcgcgcccaatcgacttaaacgacgcttcaaaacagatcgaccttactaaaagttggtcgccaattttagtgaatttcgatacggcaacaagagtcaagacgagcaggtctatttagaatcaattttagatctcttcaacggagaagttttagcttccaatagtaatcactccaccgttgaattcgctgtaaagcctctgaaagaagcctaaaatcagacttcagtgttagattatcgtaccaccgttcatactgacaaaggattccaataccagcatcgtcactggcaaaacatgcttaaagccgatcgcccatttggatattggacagccctagttcacaaaaggtttcgattttaattcgttcaaaataggttatactagacaaaagatcagctcctaaaagatgggtttgtggtaaacaccattttagaggaagctgatcttttttgtccgaacagcgttcggattaattttacaatctaccatatagttatagaggctaaatgtcagttagaaatcctgaacgtatggtattttttatactatttcatatcaacttggatagcaatctctttcaatgccctgcttaaagctttgctaatttgatctggagataagggagcactcttcttaaaaagcgtatccattaaaacaccgaatccaccaattgagtacgttagcatgtactcataatgctggttattcaaactgccttttcgccaagggacatttacattcaggagaagcgctacaatggtctgaatatgtcttgttagcaaaggaactaagagatcgtttttagctagcaattcaattttgtcatggtggggccaaataaattcaagaaaatgtttagggatagtatccggtgtaatggaagattttagtaagtaagcatgatagctagttagatatttacaaaatgctatatctaaaatttttgttttggttttgaagtatcggtaataagtccttttggaataacccgattctaatgtcaactgtttgactgtaatatgttcaaaggattcgcttttcagtagttgaaacaaggcctcaataaaagcatttttagactcttcaataatcattgtccgagacatggcacaaaaactcctttcagtggcacatgtttccattatattcaaagatacgcatcaacataatataatactagcaggagggccataaaatgattaattttagttcttattggatattgccattgttatttatgttccatgattttgaagagttagtatttgtcccatattggttgaaagatcataatcccaaaattaacgggcgtgtgctgtttggtggagcgaatcgttcagatattttagcggctggaatctgggaagaattttgtatttacttactgctcgcagcagtcgcctatatcatgggctcaccattactagttgccactgcaattttaccgtatctgtttcatttgatcatgcacctaatttttgtctttaataaacgtgcttatgttcctggagctataaccgcaattattgaattacccataacaattttttacttatacagcttaaccacattaacaaaagctccgctatgggaatggattatcgttgtagtcataatgtttatattcttcatcagtaatttaaaattcattcattggattatggcagaaacaatgcataaacttagataacacgtagcaaacagagggccttaagcaaaactactgaacattgcttaaggccctctgtttgctagttgattgataattttggacaatgctattgaactcttgcaaattgaagcagctcgtgcagataagtaataccactaggatataccttagtggacacttttgtttcagctttaataactttctgtgatcctttttcacaatctggaataacccaagtcattggttatggagttggagaattagaaagaagtcttagattacttattattgcaagctaggtaatatggaaaataatctctgcattctaggcaggtttctaattttttttagtccatatatcagtcaaaactacatcatcacttttaggtcttatagttgttggatccacttttacgaatacgggtacttgtattgcatttccagtaatcactacctcacctttacccaaacttggaatcatttgtaaggatcttttgtctaatgttggcatagtattttctaacatttttaaatccctgtcgttaacaagccggtgtattaaataattatggacttgggataaaattgttggagatatatctgcgggccgttgagaacttaatgttaagaaaaatccaaattttcgtccctcttttattatttcttcaaatatagataatcgataatcttgccaagaatcaccaacatttttatgttctgcatttaagatattatgagcttcatcgattattaaatgtttagtttgcgtgacttttgaatcagcgactatgcgtttttgttgatcatagaacattttagaaattaacataggaataagtcgtttgatttcctgattagcattaactaaattaaaaatgtttactgatgagtattcgttggttatttgatcctttatttcaataaccttttctaagctattaaagccagtttttattcggttaaatagtggatttataaagtctaaatttgttgacttccaagctgaaacataaactttttgaaattctaaaaaggcttccaactgtttaattttagtagcagagtcaaatttttgcgctaattccacttgtatttgatataatcctgaattttgcataaattgagaatttgctggcccgttggccttaatggttgcattattgctactagaaaacgagttttgatattgattgggctccagttggtttaactgtttaaatcgtgaagcttctatacctaaactttttgccgcttgaatccaattatcttttgcatcggccgctacttgtttcatcccacttaaaattgatactatcagccttatctgtaaattagaaaatgattgaccattagagatttcttcattaaatttacgaagtgcatttcgcaaaaacggaacctgtgtcgccggccttgcatcaaacagcacgctcaaaatatctggattaaacagataatcctgagtgactgttattttgtcttgcggctttctagtattaatattaaaaattcttttgtctgtttggcttagaccaaaagtattttcctgcgtatattcactattaaaatcgataactataaattgacttttgttcagtatttcagttttatattttgatttaaagagttctaaatataacttgtgaagagtgttcgatttgccgcttcccgtgttgccaaaaattcctatgtgactagcaaaaaaattgtttatagggagtcttataggttgcttttccaaaaccgatttaccaatctcgatggtattctcattacaaatatcatcttcactgattccataaatcatttctaattctttttgagtagtcaatgttacttcgttacctatcattggtacacaagaactagttatctcaaatttcccatttgtaataacaccttgcgtttttagctgtataacgcgattaatagagtttttgctatatcgattatcaaattcctttgactttattgtgttttgctgatctataactttttcagtaatcaccgaagcaattatttgtgcgtcattttgtcttatagttaaatatgccccaacttttgggcctgtcaaaatatcaccgttccaaataaaatcaggatcatttgacatattatacataccaacagtggatatagttccatccactgccacaatcacgcctaatcttttagtttttatcatcgttcacaccgtctttagaggtatcgtttagaacgtctgttaaatttttcaatgtaaaactgtaaagctccttgttatgttcatcaaaatctgtagttcgaaattccttagcaaagtcacttggaagcaaaatgacaaaattgcctttttcttccttcaaatggagattgtttaaaaaacgttctttatcattttttgaatatccgaatgcataaatcattaattcagggttttgcatagcacgcttaatcattttcccgatatgttcatcttgaaatgaaaatccaataacgaataaaacggattgttgcttatctagctctgtttcgaagattcttaacatttcataaaaatgattttgtaaaaaagtgtcagcagattcgtaaccagaagggggaacaattacaggacaagaagaaacacaatcttttattttgatattattaatttccctttcccagttcattgatccatgaggttttattaaggatatagagggtatttcggatatataattatcgttcagtcctttataagcaactgttcgattatagttagagctactcaaatagcgattgaagtatccacttgctccatcattaaatattaatctatttttatttattatgttatcggcggctttttcaataaaaaggtcataatttgtagtgaaaatgttggcgtttttgggtatttgacgagaattagataagtttaaaatatcaagtattgcttgcaaaaatttattgtatgttgtttgcgtactttggaccgagccatcttccagtagaattttcttactaacatcctctgcttttgaagtcaaatttgctgaaatttcagatttatctgatttttctaaatctttccatttgaattctttttttccccttggaaaatagcttttatcattcattagaggaattgcaggaacagatgttcctgatccaactagaaaattgagccttttggtaattgccatatttctaatgtttgcaactaattctttatccataatccgcttcctttgttagtcttgaaatatattctgtggattcaatatgtacattatgacacatgcttgctaccatatgggtcctaccctagtagctgtcacgttaacttattaaaaagggaaaaattctccttcccctaaatgatccgtattcaatcttgagtttgtaactttttgatttccatttactatttttaataaatcttctggggatataaaatttgaatgaaagggagcttctttgtaggcaattttccaatctctcaaaatattataatcttctgaaaactctatgttcttttttacaccctcaaaatctggaaataatttggtgctgatggttccgctttcttttaaacatttttgtaaagaatttcgatcaccttgcggtagtttgaaagttgttttttctaaaagagtttcgttattccataagtatttattgtcgatgtgcttcaaataaccactaggattattagtttgaagccaatcagccaatattttaatttgagagctttgaattttagccttatcgtttactcttgcgctatctatgctagataacagccctttttgtgattccattctttcgtttttatgatcagtatcatatactattagcggtaatttgggatattgattctttaattcatcatacaaggtcttatttagtctatatatgcaatatttgtgcttattgaaatcgtctctaagacaatacattttacaaagattgatatcttgatctaaaattttttcgtcaacaaactgtttaatataactggtgaacgcaaagtataaagctacatagaccgaataactccagtcaagataactagtactgagtccgtagtgctgagaaagcccatctgacagaccattcatacctacttctgcatacccgcgctcagcggcttttttaaccacgttagaataaatattatattggtcaaaactgacgtctatttttaactttctagctagagttggaactaaatcataattttcaaatgcacaccctcgataaatgaaattgttattattcttagcttctaaaatgatttcttgtaacgtagccaatattttattcctcctgtataattaaagcctgtagagaagttaaggcggtggctatttccgattggaggtggtgctttatggtgttacacctttaaagcccgtaaatcctaacgaaaggagtagcttaagtgtccgttgcggacgctttacaattaatgctggctttcggtacctttatcgtagccttaattgcattaattgttgagctgatcaaaaatcagcaaaaaaaataatccgtcttagctttggcgagcagatggattatttttagtctaatctattaagtttgccaccgtctttaacggctctacattggaagccctgttatcagcggggcttccttttctgtctacattatagcatgactatcactgactttcgactatttttaatcagctttctagcagtttaagagaacatatgtttgcttttgtgctacaatacagtaaaagctaacggaagtgatctaaatgttttttgatgatgaaccgcatggcgggctcattttagccacgtcacccgaagctaagcacttatttcatcttaaagccaacgtctcccgtaaacatgacttacccaatgaccccaggctgtgggtcgtgtcaccgcgcatgaacctttatattcaacgtaatgtgcagatcaatcagatctttcatcaatttactactgaaaaagaggtttggccgtattcaattgatgaaagcattcttgatatgacccatacttggcggctgtttggcaattccgttcgcgaagtggcacgcttgattcaaaagacagttcggcaaaagctaggcttgtataccaccgtgggaattggtgacaatccggtgcaagctaaattagccttggacctttacgctaaacataatcatgaattgatcggtgaaatctattacgaaactgtgccggataaaatttggtcaattacagaattaacggacgtttgggggattggcccccgtatggcgaaacgtttgaaccgccttcacattaacaatatgtatgagctagcccataccaacccttatttactcaaacagcagcttggcgtcattggtagccagttatttgctacggcctggggaattgatcgcgcgcaagttacggaaccaactaaggttaaagaagctagcctgggtaattcgcaggtattgccacgagattattttaaccaagtcgaaattgaaaccgtcattaaagaaattggggaacaggtggcggcgcggcttcgacaccaccataaactggcggggtgtctatcgctaagcattggtttttcctatgccgcagccgaagcagatggccgcggcggctttcaccaagctttaaaaattgaaccgactaacgacaatcaagttttgacgcaacaattattgtggttattccgtcagaattgggacggtcaagctgtccgaaatattggcgtttatagcagtaaactaagtgccaactccggccaacaacttaatttatttgaaacaccgcgtaaccaaattcgccgtagccggttaaaccaggtgattgatgaaattcaccggcaatttgggttcaccaaactagtttacgcgaccagtttattaaagggaggcaccgctatcaagcgggcttcactagtgggcggacataatggaggcaatagctatgaatagcgatatcgagattattaaggggcggttaaccttattgtttaaacggcgtccccaaacccgctattggttaatgttgactaatgacacctacgatcagacctataatctgttttttaacagtcaacgggctaatgagcgcttgcaatctgttcccatacataaattagctcactatgatttagctggtttagaaaaattactaaaagcattacgacaagatataaagctaacgatcgaatttgtcggctttactggggaacggtggccggcaagtcaaaagctgattcaacgaaagcgggtgccccttgaataaccaagactttgatttagacacggttaagcatttttttgaacatgattaccatgaccggggcatgatgaaatggcagggcttctatttatccgatcatactgccgcattaaaccaacagaaccagcagttgaatgcagtatacgttccacgaccgcaacaatccttagcaacaattaccgaggtattggcggacgcatatcagcgtcagcaaccagtgaccattcaattaaaaacggttgaccaaaacaaccgccatttaccagatatcaccaccttgatccatggctacaatgccaatgatattgtgattgacgctgatcggtttatcccactacaagaaattcgcaatgtggcctttaaaaatacggagaagctataaaattctagctctccgtatttttcttaacactttatttgctggctctgttttttctcattgctttattttagacaattttacttcaatgtaggcaaaagaattcacagaccattaccattaattgataacgtttttcaaatcacctgataaatatgcttttatattatcaacagttatatgcaataaccgttctcttgtttcatatggtgcccaagcaatatgtggggtaatataacaatttttggcctgtaataatgggctatcactagcaatgggctcccctttaacaacatcagtggcgtaggcataaattttgccttcattcaaggcattcttaatgtccgcttcattagccaatttgcctcgggccgtattcaatataataaccccagttttcattttggcaatcgtatcattattaattaaatctattgtttctggtgtttgtatcacatgcagactaagcacatcagattgccttaatagttcatcaaatgaaacctgctgaatccatgattcaggaacctttttaggacgatgattatagaaaataactttcatagaaaaagcgtgtcctattttagcaactttttgcgcaatatggccataaccgattagtcctaaagtttttccttttaattctaatagcggtttttcccaaaaagtaaaatcaggagcctgtgcccaccggttttcatgaacaagctgattatgcaatccaacttggctagtcacttctaataataacgagaaagtaaattgtgccactgcgtcacttgcatatgtgggaatgttagtcaccacaaccttgttctggtgtgcactctcaatatcaacgacatcataaccggttcccatgattccgatatacttcaatcgtgatgttttgctaatcacttcatgatctaggggtgttttatgtgtaatgacgatatcagcatctttaattcgttttatgatttcagagttatcgttaactggcgtacgatcatataaagtgcagtcgcctaattcttgcaagcttttccaatttaaatctttgtttagttcatatccatctaaaagaacaattttcatagtgttaaatccccctatcttttcaatgttttagctgcattatgttctggttgtttaattgccgggttttgttcagaaaatgctttcagttgtttttgcgttcgattactgatttcatggtgtacatcatttaatttattttgtagttctgctttttgttgtggattagttgcttgctgaacttgttgttgcaagccttgataggacttattaagatcatgggctgatagcttttttagatcatgctcaggctctttttgggcttcttgtaagcctaattgtttggttaagccatcgctaagttcaatcactttgttgctcacttgctggatctcacttaaagcgctatggattacggctttatctttagcccaggtggccacgtaaccgagtgagtagttgctggtatcaacgccaatattttgcatggcaacatacgcaaccgcttcggcttgggtttcctgataggctcgtggccgatctttaaaggctgattttaatccatgtaactgactatgtgcatattcatgatataacgtcttcaattttaaagcattatcagattcatcaccaccaataacgatttcattagtgctgggttgaaaataccccttagccccatttagcgtcgctaaaggcacttcactgactttaaggtcggtttgctggtttaaataatctttgaacgcgttatataagcttgtcacattctgatgatcggccaaattttctttgacaaagtctttagcacttaacactggttcaccgctagtttgtgccacatcaaagacgggtagatagcgataaccgacaatggcgcgctcatcggtggtatcaagatgctgctgctcggctggtgttagcttcttaatgatcggagccgcaatccgaatcgcttttgcgccccggttgacggtgcggttaaaagccttctgccattgcttaaaacccgcgacttgagtggcttgaggattttgcgcataaattaaatcaatgtttctggcgctataacgatgaaatttagccagggtattgagatactttttaaattggtcactatcagttaattttaggatttgctgttcagcctgggcgactaattgtgctttccaggctttaacgtcggctttactcggcattgtctacccctcctcatcttcaaaagtatcattcaataatgatcttatttgaatcggggtcgtgccataaagggcaacgtagccatcggctaatttttgccaagccacttgataataagccccattttcagtaatttcttttaaatacttatggtagattgtaaaatcaatccgaatgaagcttgaacaaaaactattttttaagttgctcaagcttattagaccttcactcttattacatgtataggctccactattcattacagaatagtccatcaacataactggcacatataaatcaactgttaaccagtcaatttttttggcgactactaccatcattctatcaatttatttaaattcttatatccatcagcaagtattagcattctagatctaattgaataatagctaagttaaacttacatactgggcgcaaaacatgtattcataactgccaccatggctatttcaagtatgttttacattagcacttcttgttagcaaaaatggtccataacaatgttactgattccacattgttatgggccgttaagttatttcatcaggtcatcaaacatttgattaaccgtctcttgatcacgattgttcgtaaacgctttaactggttgtaagtcacttaaatcattggcaacttccttcgttgcataaatcatcactggggtacgcttcgcaaactgggtttggactaacgccacattaccaactaccggggtgcccttcgtcttttcggtaatccgccacttatacaactttttcgtattcaaaacatgttttgcccgctcatcaggatcatgcacaatatgataggccattaacacattatcagccatgttgattcctcctattttggccagtagttattccttaacaccattagtatacgtgctgagccctcaaactagcaattatttgaaccaagccaccaatcgatcaaaccaagtttggtgatgaccagtctgggccatcttaactactttagtaaccgttggcttaggcgctggagtcgttggtttggccggggttaccggcttatcggtatgatacttaaccgtactggtcttatctttaccattagacgcttggttattccaagtataggtctggccttgcttggtcaactcactatcagctttgtcagttgggagactggcgacaaagcgtgttttagtttgcttaccagcatactcagcgattttatcagctttgggcgtcacggttaacttaccgttctcaaatttgactgtgaaatcagcggtcacatctttagtgtaagtcaatgtcgctagtttttccttagtcattgttttagcatcaatcttgctagtctttgatgttgaccgatcatcagttttagctgacgaactagcactcgttgcagttgaggattggtcatcggctttagatgatgaactagcgctcgttgcggttgaggactggtcatcggccttagatgatgaattggtatcggttgttgtggtatcagctagatagactttcaccgctttcaaatcaactttcgcatctttcggcagttgatcagtatcggtcatatactgagtttcgcctaaattgttatactgattgaaaatgttgaaaggcacggttttggcgttgataatattggcattggccacgttatcggctaactttccgtccttggtttcgaccttcttagtgatcaaatcagggtctttttcagcattataatcaacgttattggacgtttgatcgcccttagcgactttattatgccaaacgtagtcgccatctttcttcgttagttgactatcagctttttccttaggtagactcgccgcaaaccgcaccttcgtttgttgatttttaaactcagcttctttaccagctttcggcgtcacggttaacttaccgtccttataagcaatcgtaacatcgctggtcacatctttcgtatagctcagccccgtgagcttatcagccgtcatgctaaagacatcggcctttccatcgctcatcatcaccttgatcttactggtatcaacttgcgcagctttcggcaattgatcggtatctgttaaatcgtcagtatgtgagttgttatcgtactgattgaaaatatcaaagtaaacgtccttacccgtcaagatattaacgttgtcactcgttgttgcaagcttgccttgggcatcttccacgcgcttagccaccaacgatggtgagagcttctcaactgggttacttggtgtgtttgaatctgtcgttacatcattgattttggtggtgaaattgttcttgaccgtcacattgtcggcattgacggttgtgactaacttagcttctggtaccgcataggccttgctcttatcggcattcatcgcctttaataagtccgccttagcggtatacgtgactgtttgaccgtcaaccttcacgtcccaattcttagtattagctttgacggtctccgcctgattgaccgtgagttctttttgaaccttatcagtcagcacataactcttaatgtcatcagttcgattagctggcaaatcagaattggttagtggataagtcaaggtatctcccttatccacggtcttaccattaatggaagctgtgtccttgccctgattatcaccggcagtgacatctttatgattacttggggtgaccatcaaatcagttaattggtaactagccgtttctgctttaggcttggttggggcgaccggtttaggctttagtttgatggcaaaatcaatattgccaaccgcaaaataatcatcagattgataaggggctgaccaatggtcaattgcttgcccccacgtataactaaaaccacttacattgtctaatcgccgccaaacttgggtcccggtttctgaatcgtcatatgctgtatcatcatgagccttatagctatcatcgctaaccttggtcaccttatcaccataaatcgtctttacagcctgaccatcaaatttaacatattgactggcatctaagtcgcccataccaattagggcttcctttaaagtgactagtttgcccgaagcatgatcataaaaattaaccttataatgcccatacaaattaggggttgctaaattagcgcccatcgcgtatttgcttaaataagcatatgcgggagtcttttggttatccaatttatcaactgtaaatttaacatcaactggcttgcctgttgaaacatcaacgaatggtgattgatatgtgaatgttgacccaactttcaagacgacccacgtgccatttttattatcaacactgctagtggtactgccacccttatacgtttctaggaaagtcttgaattgcgcggctgtcatcttactaacgttgccataatccaacgtcattttattagtcgagttagagacatacgtcacattagcgggattattaccaatcaagtcttgtaatgtctgtttagaccactgcgtactgttggtatattctggatctttcatataagcttcccacgccgccaaatccttttgatattgagcctctgcggtattgtacttatccattgcggccttttgggtcgccgtcactttggctaatgcggtcgcttgggtgttgtaatccgtcgcaatatctttttgcgcttgcgttgcttggccactcgttgcgaccgtatttttagtggccttttgcgtcacgttaacgccggccgctttggcttgtgtgaccgcggtttgaagggctttatcatcaaccttaactttcaacccgttagtttgactaccgttcccagtgctatcagcgcgcgctgtcatgccacgctggttaccaactgcgactaatggggctatcgtcaaggttaaagctgacaaaactaacatcttcttaccataaagctttacttctgcggttattttgggattcatcgtccaccactcctcttttttaattgaactattctgcgctcgtgctggttaagttgccttgcaccacctcccgcattgaccccgtcgcattacaagtaaacaacgtgaccatggcttgtttaggttgttgatataacacgctagtgctgactggactgccgttaatataggtctggttaggggtaactgcttttttaccagtcaacagccggttaacccggtagtgataaaccttggtagcactaatcaagttcaccgtcgcacccattttaatttggggcacatttgagaatagcacccccggcatcgtcatattatgaccagctaacacgtaattgccttgtcccatctgctgatgggcaaagtaagttgtcgcccccaggctcaacgtatattggtttgttccttgataaatcggtaatgctagcccaattgagggcactttcacgtaggcaattttccggttagctaagcctgcctgttgagctttacgctggattttcaatagttgttgataatcctgattagtgacgccggcgttgttatttgccgtgtagcgctgcgataacgtctggctctgactagctttagctactcgcccggtttgaccactcactccacttactgtttgcttcaactgcccttgtaattgccgattactcttacgtcccagtcgtttttgcatctgcacatactcagtcgtcatttcatgagcttggtactgtgcccagccccatatcccgccgccaatcagtacgattagactgacaatgccaattaacgccgaccacaactgatgttgcttaatccattgcatacctcacacctacttttcactcgtttttttagccgctgatttggcggtggcttgggctttagttaattgcgccttagtttgactagcctctgcctgtgccgtttttttatcctgttgtgccgccgagacttgcccctttaaagccgtattatgttgactcaattgataatattgccggtttaatgacgccgtattcgattgagcttgccgcaattgttgttgattggttgttaaggcttgggccacttgttgatgatcgtgataggcccacaagccaccaccacccagtaccgccaagcccaccgcagttcctaggcccaaacccactttctgtagtgtcttaggctggggctcgcgctcgaccgacttagctggggctggctgttgtttagttgccaattgcgcggctaataactgctctaactgactactcgccgccggcggttgaacctgcccggattgttgcttcaactgcgtcaattccgtggtttgcgtttgtaatagtttttgcaggtcttccttttcttgcgtcacattttgcttctcagctgcgacccggtctaacttgtgttctagttgttggacatcaactaaattgaatttggcgcgatcagcactggcttgggtttcaaccgcatttagatgcactttcgtcacttctaaggcgtattcgtccaactttttggcaaggttttgataaaccgtcccggcaatattttggttattggccaccaatttccccacacggcggttataatccgctcgcgtttgctggtctaattcatgctttaagctggccaattgttgctttaaagctgtctgccgggctttaagttcactagcatagcgctcgttagcgtcctgcacggccttggtatctaagtcttgcttaatcgcttgcacttgttgctcatactccgcttggcgttgcgtcacggcccgctcggcgtccgcttgaatttgttgcacgtcaacgtcacacttagacttcaaatcggccaatactttagcctcggtttgggctttactttgggctacttgggcttgaattgtttcccgcaaatcggcctgtggatcatgttgggcctgatagtcccgtaactgtttagcaatcgcttgccgctgttgttcgctataactcactaaatcctgcgttgcgtcggcattaagtcgttgctcgagtgtgcgcaagtaagtattgctatggcgcttcttttgttcaacttgataagcgacgtattgttgatcggcctcgggcactgccgccaaattttgcaccttaaactggggcacttttatttgaccaatccgcgacggcttaggtatcaccggcattttttccggtttagccgttgaactcccctccgcttgactggttgattcattagacccagctgtacgatcacccgaactggtcggctgacttgttgtggccccccctgacgccgctactttcgtagcctgatttttagtcgcggctcccgtctgactagcgggtaccttttctgtggcactacttgccgccggtgcttctgacgccggcctagttgctggttgaaccacctcatctaatcccgcataccggacgtgaaagtcatcagcctcagcttgggcttcacttggtactaaggccacaacttgttgatcgggattggcggcttgataagccgccataaactcactggcccaagtccgcttatcatcataatcaatgtccgcaaactctggtgcattgaagatactgttgatcacggccccggtaaaatcacgatagtcacgatctaaagtaaatcgccccacccgcacatagggctcatatttaaacccccgaccagctgcttgccgttgtaacacggtaatcgtttcaaaactcatggggtccccttggtcaattacgtgttcccgtaggcgttgaaacaactgacaagccacgttcaacgtcatcaatggtagctgctggataattcctgaccgggccacgcgttcttgttggctcaattcttcaatcaactcagtgacaacggcatcgtgtcgtaatttttgactatcccccttactaaattccagtacaaatggctcttgtaacttcgcgcgttttttaaataatgccatgttgttaactcctttcaaacttgcgggttatgtattaacggggtagtaacgtcttcgttacccccgctactgccccgtttagaaaatcctcacatctaactgccgaaggaaccttgcgaatacgtcttcgctaaggttgcgatcgctgaaatggcaaacaaaccaatcactgaaataatgatccaaattaggtgactcttgatcttgtcacgtagccgatcaccaccccaggccatcagggcaaaacaacccgcaccaatcgcgatagcgccggcaaaaccgacaatttgaaaagcattcgtcacctttttcataatactttgcgtgttgctaaccgcatctaagctcggtaatacttttaaatacccggtcactgcggccaatttgaaactagctaaccatgttgacatcggtcttcctcctttccataaccccgagtttacgtgctccgtcaggtcacggcgtaaccctgccctttaacgggcttcaataatgacctttaaatcaccaaagcgatctttttgcccttgaaatacccctggccaccggccgacaactcggactaaatagtgatatttagttacttgggtcgcatcttgttgtaatagcacccgcgctagcgccgctttaattttggcattcaacatatacgcaattggccgggccccattggtcacatcaaaaccaacggtcgctaggtattgggccacctcgggactaaaatcaacttttaactgccgttgcgctaacgtcgctttaaattcttttaaatacttggttgcaatcgccagaccaatcttttcatcaagcatgttaaaaataattttgtgctcaatccgattcacaaattccggtcgaaattcattcttcaacgctttttccaccacggctttaaactgtagttgccgttgttcaccctgacgcaagtgattgaattgttgttgatcgttaaccactttagcggccaagttcgtcgtcataataatgatcgtgttcttaaatgaaaccggttgatcatcactatcatgtaagatgccatcttggagcacttgtaaaaataagtcttggacatcatgactgcccttctcaatttcatctaacaacacgatggcaaagggttggtgcttaaccgcttcggttaaggttcccccagcgtcagcggtccctaataagcggtgcaccgcatcttggtcgttatattccgacatatcaaaccgggttaaagcgtctgacgacccaaacatggcctgagcgagttgtttagccgtttccgtttttccagttcccggcatgcccaaaaacagaaacgaactaatgggcttagtcggatcttggaaccccgcaaaatacaacgttagggcatctaagaccccttgaatggcttgcggttggcccttgatattttgattgagccgacgttgcacatcgttcagctgggcttgtcgatccttcataatttgatgtaaaggaatgtgcttgcgctgttcaatgaccttcgccactgtcactggcgtgacggctttcagggcatgggccttcgcatacgcacaactttcatctaataaatcaaacgccttgtccggtaaataacgatcaggtaaataccgcacggcatagtccacggccgtcttggtcgcggtcgcgtcaatagttaagtcatggtatgtttcgtaactagcctttaaaccggctagaatctgataactagctaacacactcggttcagctaattgaatcacatcaaaccgtcgggctaacgccccgtccttttccaaataacggtgatattctttcgtcgtggtcgcaccaattaacgtgatttcgccccgcgccaaggctggctttagaacgttactaacatctagggcattgtcaccatcactgccagtgccaacaatcgtatgaatttcatcaataaacaccatcgcccgactagcttgtaattccgtgagtaaagctttaaagagacccatgaagttctgatcactttgctttaactgggccagttccaacacataaatgggctgagcttgtagctcggggggcacttgttgcatcacaatccgcttagctaaaccttcaattaaattggttttaccgactcccggtggcgcaatcaccagcggattccgtttatttttgcgacaaagcgtctccaccaactgttcaatttcctgattgcgaccaatggtttgatactgatcaggattagctgcgaccactttagtcaagtcttgggtatactccgccaataaactcatgactataaccctggtagtgaatctgatgctggtgtgtcgtcaacctcttcacgggttaatttgtcaccatcggcgccaaagattgtcggctgattaacagtttgttgattagtcggttgttgttcaaaatcagtggccgtaaatggttcggggtgcccttgacttggtaacgctgatggcacatttaacttgggaacctcttgatcaactttagtgttactcgctaggtgttcagccaccgcactgccaaccgtttccgggtcaaagtcttgcgtttcatcaactggctgtaagtgttctcctggtttgtcttcctcgacttgatcagtgctggtagccggttctattcccgggtctggtaccgttttaggctgctgattggctaattcactaggccctgacagtgtctttacgccagcttcgccagttagcgtcaatacctgttttgcttgcaaagcttgtaagacttgatcaaccagcgcttgatcaactggtttttgaaaaatcaattcaaccggggtctcaaaaggaattaattgcccggttaggcgcaagtctttacgttccccccaagtaatccccgttagtttcatcgttgcaattgacatgcttataacccccgttctttcaattgtgataaccattgctctacctgtttggtgctcgtaaaacctttggcttcaattaataaccgcccggcctctttttgtaaggcggcttcttgggcctgaaaggccacttgggctttttcaaaccgttctcgttctgctttaatatcaatattgcgtaaccgtcgactactcatgacaaacacttccttaattttttaaataattgaaattgatcaaaagtttgcatatcaaaggtcaatttggtatacggtccagccttagtcggttgtaattgtgcattccaatccttggcccctgaccattccaccaagttttgacacgtttggtggggcgtgattagccgcatgtgttggaatttttcaatcaaggcgcgccctgccacatcattgtccggtgccaaatgtaaataggccggtaacgccggttgggtgagcaggtaatcattaatggtctgcatcttggcactggccccactcaaactcagtaactgactgccgcttaactcccgggcgtacatttgccagtacgacagtaaatcgattggtgattcgaagacgtacaagtgtttaaacgggcctctaaaccggacattaaacccgtaatgtggcttggaaccggctttaatctgctttaacgagccatgtttggggtaacgttgtcgattgatcaccgtgccttgcacatcttggcccaccaaggtgccggccgcatcaaaccagttaaaaatcacattatggtagccatcactgcctaataggccttgccgagcggcaaaggtaattaagcgtgaatccagatgccgatactgcgtcagataagccatgccagccgcatctaacggcgctaccggtcccaccgctgacttcgtgggatagtcagctttcactgcgactttttgctggggattagtcttggtaaacgctttgagtctaaagtgcatttcacggtcactaataccgtaataggccttaatgaattgactcaaattaccagctaacccttggctgttccaaataaagtaatttttgcgggtatcaataattaatgaatcgtgttcctgtgagcgtaaataccggccttcatgtttaaagggcaacccagcatagctaacgtaatccgcaagttgtaacgccataaaaaaagacctcctttaccagtaaggatacttactactgataaaagaggtcgaaacctgttattgaatttttaaacttaatttatcatcataatccattccctgagtctccattaacataactttcctccactctgcttaattaaaatcgaaccttagtttgccggcttctaacttcaacttggcactaaatgtttttcccgttttcttactcttaaagcctttgagttgggccgtttcaccagtcttgatcagttgcttgatggcacttattggcaattttttgccactccattgtttgggcaacgtaaacttacagccatttttgtaatttgaacacccataaaacttgccacgatctgaaatctcacccgttttacatattattccttttttgttgccaaaaattagtctactgggcgaactaagactaaattttgaaattcaaacggcgggtcggattattaggaatcccggtactcatcagcgcattgggaattcaacctatactattaatcaccggcacgatctacttattggttgcaatcacgctcattgtactgaataagtttccgttgagttgaatcgttagcgattgcgctcaatgctcatattgggggtagctggcagtgatgggggagctgtcaaaacgagagacagtagcgttcggattttgagagtcaggcgtaaatggcgtacgtttggttggttagaaaaatcgatgctagtttcaagcgataaagtgattcagctcagtctaaggtactaggtattggtttacgaacttggccattactaaccgctaatacgggctcgtgggcctaatgtcatttaatttggacagtatccgtcataaccatgtaaaaatcatgtaaattcgggagcaataattgttattctagcagttacgtgctatgttattatcatattttatgaagtggagtgatagttatggctcagatttctgtgggggatcgggttaaatgtcaaaagaacggcaataccgattatgatttttatgctaaagttgaaaaaatttacgagaactccgccttcgtcacaattactcattatgatttgcgggatgatattaatgtggcagaacttcaatatcgggcagtgatcgccttaaagaagatgaaacccgctaaaccgactgctggtgaagcgaagcagctacaggcagttagtgcggccatgttagctgaataaattaagaatatcgatgcaacatgtaggtaatgggttgttcaagaatttgattcttgaacaacccatttttagtttggctgcaaagcttttcggtgtgatggagtgccctggttgggactgattttatgatgattagaggccaactgacttaatgaatctgtccgttagagctttaacagattggatatttaacaatcattcacgcgggtgttgttacaagctaattgtgcacgtctctttattcggtgtagcaaacttttttgttggcaatctgacttttagcctgtacatcattggtttcaatggtacaatggatattagtagttgataactgttctaaagtaaggaggagttttgaatgcagacagctaatcaaaatgtaacgttgacggggcgtcgacgcttctggttcatttttacgctgttgcttgggacttggaccatgtcgatcagtcagtcttccttgtcgacggtctacccaacatttatgcgcgactttggcatctcggcctcaaccgtgcaatggttaacgaccggctttatgttgacaatggtcgtcatgatgccaatcagtccgtggttgttgaataatattgggtttaagaaattattcttagccgttttggtgcttttcgatattggttcaatcattatttatttcgcacccagttttggtgtgatgatggtcggtcgcctaattaaagcggcggcagttggcgtgctgtttccctcgtatcaatccattttactgacgattacgcccgaggaaaaacggggtagtacgatgggtgtcgccgggttggtcatgggatcagcattagcatctggcccgattatttccggtgtggttttgaagtttaccgattggcacggattgtttgccgtcttcatcacggtggcaactttgttgatcctaattagtttcacaacgatcaaggacgtgatggtcaataagccttcaaagctggatttgctctcaatcgtgacgttactgggctttgctgggattttatacgtcgtgaatgagattggtaaacccaatgtgaactggacgttcggttggctgttattagcggtttcagtactagcggtggcttactttacttatcgccaatttcacttggagacgccgttattggaactacgggtcttaaaaacatttaattatgacttagccattttcctaacagcaatctcgtacgtggcgctgattgtcgtaacaatcatcttcccactctattaccagggtgtcttgaaggtgtcgccattcgtttcaggcatgtcactggtgcctggtgcggtgcttctaagtattttgaacccgcttactgggaaactagcagagaagattggatacaaacaaatcatgttacttggtatgagtatgatcgttgttggttggctgatcttagcactgatcaattcagagttgaacctgctcaccatgattttgctggctgccttaattgaaggcgggaatgcctttgtcatgatgcccgccgtcacattgggggctaattcattacccgatgaactgatttcacacggtaccgctgtgattacgacggttcgtcaaattctcggttcagctggtgtggccgtggcgaccttggtcttatccaacgtgacgcttgctcagaaacaagcgggagcctcaacgttgcgtgcgaacttgcaagggtaccatacggtcttctggatgatgctcggcattgaattggttggcctcgtgcttgcgttacttttgcgtgatgggcgcaagcagtcgcattaataatcacggtgactgactaccaggcgagaatgactgaagttaagtgggatatgctttgaacgccactaattagacattagtgcctgcacaatcggtcggttagtcgtaattaggccaaaaggaccgccattcttgattacaagaatggcggtccttttttcgtggcgcgactgtgatcgtactgaatcacaggaattggcccaactaaccggggcgcttctacttggctgttgctttttgaatctttgccaattgacgatattgactgagcatccagctttgatacgtctggttggccggtaacgtttcggtgaccttcagtaccggcacatcgtatttcctggcgagtttgaccatgttcgtgaccaagttactatcggtctgagtgttttcaacgaaaaaggcaatccggtggtgcttgatgtcttgttgcatttgctggatatccttaggtgatgggtcggaaccctcttcaattgcatgtgcgaaatgcgtattgctgattcggtagccgattgccttcaatgagtagtcaaagaccggctcactgacagcgacacgctgattatttgcatgctgtttcaattgtttgatcatagtggttatggtcttagcgttggtctgatacttttgggcctgctgttcaaaataatgcttgtgctgcggctgaattttgctgagttctgttgcgattttagttgctaatttgggcatcgttgtgggatcgtaccagacgtgttcgttggccccgtcagttttatgagccacgtcggttcccactgtgattacccgggcgcccttggctttgttgacagtaagcttttccatccagtcatcgtagccgaggccgttgtaaatgattaattgggcgctactagcctgcttagccgtgttgacggtcggctcgtagtcgtgggggtcaacgctcggtcgatcaataatcgaggtcacttgaccatactttcctgccaccgccttagccgtttgaccataaaagtcgagactagccatgatattaattttgtcgttagtcgttttactgggggtgctcgaactttgacagcctgctaataggccgctgagtcccagtattattgccaaataaagccatatccgtcggttgaccatgtattgtaaccccattctctttaaatcgtaaccattactgttaactttaccgaaagaaacggtcgtcgtcaagtctttaagataaggtttagactaggtgaaaacactgcactgactgacgaaagctggtaaaataggcgtacctgaaaagcggaaggcggggcacgcagatgatatttacgattgtgattttaattttactagcaagcgcaatttttcgcgggtttcaccgcggatttgtgattgaaatgttgcatctgattgggacggtcgtcgtcctattgtttgcacgactactctatcagccgttagggacaatgattagtaatctattgacgaatttacatttaattgaagcttcagtggcgacaacgttgatcattaacctggtcgctttcttcgtgttaatttcgttagggtggtcagtgattcggttgttaggccgtgtttcacgtagcattacgtggctaccagttattaagcaagtgaacagtgttgcgggtggaatcgtgtcatttgtcgtgacgtatctggttatttttgtcgcgttgtcgttggcaaacatcgtcaatacgagctttattcagacgcaaatgacgcagtcaccgctcgccacctatattgtgaagcagacacctggtctaactagccattacctcagtaatttgattaattttaatgatgggacgactacggattcctagagttcatggtgggggtacgactgctttaaactaagacaaaggcgttactggttttttgaccagcaacgtcttttttgatgaaccggtttgttagcaacgcacttttttcggttcccgaacgattgctagtttttatggggttatttggctgattactatcatattgagcgtccttcatgctatgattataagtaaaaatgagcaagaaagaggctgggatacttatgggcatgattcgaattaataatttacgctttcacacgtttaacggggtacttccggaagaacggcgtaatggtcaacaactagggctagatattgccattaaatatcctatcgaaaccaaggttcaacacgatgacgttcacgagaccatcaattacgcggcggtccgtaacgtggtcgatgaatttgtaacgacccattcatacaagttgattgaatcgctagctaaccacttattgcagacgttattgacaagttttcccgcggcggatgcaatcaatattaaaattcgtaaatatagcgtaccaatgcctggaatctttgatgatgtggaaattgaggtggaggggacgccgaatggcaagtagggaagaacgggtttatttgagtgttggttccaatattcatccgcgcgtccaaaatattcagcaagcccttagccgattacgagccgtcaatggggtaaacgtgattgacgaatctcattggtatgagactcaaccgtggggaaagcgtgatcaggccaatttttacaatgtttcggtatccttaacgactaatttgacaccagaagaactattggatgaattacatacaattgagcaggcgggccaccgccaacgcttggttcactggggaccacgtacgattgatttggatattattttttggggcgaccggcaaatcaacacagcgacgctgacgattccgcatgcgcaggcagctaagcgcaactttgtgctactgccaactgctgaaatcgccaaaactgatgtgttagttggaccacaagtggcccaattgattgcggctaatcaggatcagagttggattaaaaaagtaagaaatgtgagtgagttagatgattgatgagaagaaccaagcaaagattgagcatgcagtacgagaaattttaagtgcagttggtgaagatcctgaccgaccgggattagtagaaacaccagcacgggttgcacgaatgtatgcggaagttttcgctactaagactgccgcaccatttgataattataaactgttcaaggttgagcatccgactgaaatggtattacttaaggatattccattctattcgatgtgtgagcatcaccttttgccgttttttggcacggttcaagttgcttatgtgccgcagcatgaacaagtgattggcttgagtaagattcctcgcttgattgactattgcagtcaacagccgaacgttcaggagcggttgacagtttccattgcaacagaattacaacgaattcttgacccggctgggatcgcggtctcaatcacggcgcggcacatgtgcatggagatgcggggtgttagcaaaccgggtgtgcatacggaaagtagctattacagtggtcaattcaagacggatttagacttgaaacgagaattcttacagcgaatcgcaaagtaggtgattaagtggatacagggacgattgaacaacgttatcaggacttattagcccaactaaatcaagccatgttagccaataatcatcagcgtgttccgttattacggcgcatcatggcacatcttggccaccctgaccattattaccatgtgatccatatcgctgggactaatggcaaaggctctacgggagccatgttagccagtatcctgcgggcgcaagggtatcaagttggccgcttcagcagccccgcgattaatgatgcgcgtgaacaactgcaatgcaatgggacgtggatcagtccagcggaatttatcgatacgtatcgtgagattctaccggttctgcaaaatatgggactgacagctagcgatgtctccatctttgaatggttctttctcattagtgtcgtttggtttcggaatcaaaacgtgcaatgggcggtcattgaagccggtttgggcggcttgtatgatgcgactaacgccttagccagtccccaactcacggtatttactaagattgccctcgatcataccgccattcttgggcccacgattaccgcgattgcgcaaaataagtcaaaaatcatcaagccccatacaacagcagtgacattggctgaccaacacccagaagccctggctgttttgcagaccgaagcgctcaatcaaggtgttcggctagtgaccgctaagcacgcgcaactgacggtgactgggcaaacactcacgcaaaccgtcgttgatgcgcacagtcagctttttgattggacgcaattaacggtcggactgagtggcacctatcagctacaaaatctgcggttggttttaactgtggttgcagtactacaacagcaacaagttaacttgacgaacagtgcggttcgccgaggcttgcaacaagtttccttgccaggccggttgaccgtattacaggagcaacctgtcattattgccgatggggcgcataatccggatggtatggcggcactagtggcaagtgtgaagcaattactcgctggtcgtaaattgatttggatcgtcggggtcttacaagataaggcctaccctaaaatgctggctgaactattaccggtagctgacgtcctgattacgaatacgcccgcaaatccagaacgagcgttatccgcgactaagctggccgacacggcgaacgcattattaacgcccacctttatgaccacggctgcgatgcaacgacagccagacttattgactgcaacgacgatcacggatgcgttaacgcaagctcagcagcaagcaaccagtaatagtgcgattattgtaacggggtcattttatgtcattcgtgagctccaacaggctggttggccggggttaagccaatgacgacgacttggttgattgcatccaacaacgctggtaaaagccgcgacttgatcgcgtgtttggcttactatggcttgactgctcgtcagtacttgacagtggcgccgcggctcgaatttcccgtggaaacgacgacgagctatgtcgataacgcggttgctaaagctcgttttggggcgcaacagctaggggttccggttatcgcagatgatagtggcttagagatttccgcgttaccagacttgttaggtgtgaccacggcgcgcgacttaggggttgcagtcagtggctttgatcgcaatcaggaaattttaacggccctacgcgatattcctgacaacgagcggcaagcgttgatgcgtgctacgttagcggctgcctggccagatgggcggaccttggccgtacaagcttcgatcaccggctacattgcgtcctatcaatttggacgctattctgggggatttgaccgaattttctggctaccgcgctatggtcgaactttggccgaattaccagcaacgtggcgcatcccgctgacacaccggggacgggccgccttaaaattaatcacaaaactttaaaaattggaaggatcggtggagtagatgttagtacaagatatcaccagttcattagcacaagcaacggattttgcgagtcaggcgttgaatgttcaagttcaacggcaacaacaattagttttacgttttagtgattataatcgggaacaacaactccggttaacccaactgtgtcagcaattagacggcgttgttcaggcaagtcctgaacaattgacggttttattaaatcaagcggcgggacggcagttagcccagcggtggtcgacagtctttacagatcaagcgaccgttcaaattcaattaacgcaaattatgaaacaatacgatattttctggcaagctggggagcatcggttcaatctgacgaaaaagccaatgatctacggtatcatgaatattacgcccgactcctttttcgacggtggccagtataagactaaggatgatgtactcaaccacgtggatgcgatgttacaggcgggggcagatgtgattgaggtaaacggtcaaacaacccggcctggctttactgaagtgaccccagaagtcgaattagagcggacattaccttatattcgggcaatcaaggaacggttcccagaagcggtgttagcagttgatacttacaagtatgatgtcatgcaagccgtggtagcggaaggtgtcagcattattaacgatgtgaatgcttttacggatgatccccggaagctcaagttactagctgatagtcaagttggtttgctaacgatgcatagtagtcgtgaacaggagtatactgacttgacgagtagcatgcgtgactttttcgaacaaaatctggccgcgctcacgagccatggaattgatattgaacggattgctttggatcaagggattggctattcacaagttgcacatggtgagcaggactacgtgatgatgcggaatattgatgaatttaattatttgcggcgcccaatgatggtggctatttcgcggaagggctacttgggcttgttgctaggattgaagaaggaagatcggttaccgatgacgcttgttaccgaagcagcgatgatgcttaaaggtggccgcgttattcgagtgcacgacgttgccgaaactaagcaattaattacgttgttaggtcggattgagaatggctattggttggcaactaatgattagctcggatgatttcaatgatattacggctaacggggtcgtagattacgatgcttactttggtacgcctacgcatgatgaccacgtcttatttgaattattagtggtcggtatcttgcaagtaggcttaggctggcgagtcgccgccagtcagctaccagtgttgcgacaacacatggcgggattacgtgtggatgctgtcgctgccatggatgagccggattttgaacgattgatgattacgcccaaagtgatgcacaatggccgtaagttacgtgcaattattcaggatgcgcgcgccattcaacagttacaggctgagtatggtagcttcagtaactacctgtgggcgtttgtcgatgcgacgccggtcattatgccggcgcccgatgatgaattaccgacgcgctcgcccctgggtgcccgcgttgcgaaggatttacatcggcatgattttaccttcgttggaccagtcgtcacccacatgtttttgttggcggcgggattgattaaactgaattagtcagaattaggctggcggatgctagccttttttgtttggggactaaataaccgttcctgagtataaaatgatgacgaatactcagatgtagaaaatataaatgggtatgaccgaattagtacctgatttagttgttattgaatgcaatccgtattgtgctagctagttattatgaatcgtgattaaaaccgggcaacttaggtggattactgttcgtcagccgatgttgatttgagctcgagcaacccccgcctggactcaaatacaagtcttatttgcgctataccatttggagttgataagcaaatggccttgaggcacctttttctataccatttgatttgttggattcttgaggacgccaaagcaggacattaacatggcccaatttgctatctcaatctaccacagtaaaagtttagaaaggatgtatcaataatgttccttactagtcgctagtcggtctatccgaaatgtactcgaaataaaagacttaaacatcaaattttacgaagattcttacctgaaaatcgttaatggatgcgaatctttgattatcccggccgttttggcctatttaccgccacgttgtaccaattgtgtcttcgacaacctagttaaaaacggttttaacgctaatataatcattgtgccaatcgaccaatttatctggttttaaagcgtcagcggtttttctatcgaggatactacacaacttttgacgcgcagatcaattatatttggcaaaactatcagatttcacaaccagttcgttagttgattcttagtgaaaccactcgaaatcagtcaaataaagacattgatcaacttcgacaagacagctcaaagaacctttgacgggaagctagccaacatcaacaacacgccaaagatcaactacctaagcacctggtatttgaagagtttgcctcagtaggtaaaaaagagctttatttggtgtcattccgatttattgaactagtcggtatatcaaagcgtactttcgcggtttctcgccaaaattacgtatgaatgccgtttatactaaattggttcccgaactctttcctggtaccaaagttcccagattatggtggaccgtttccacattatacaaatggcgaatcgcgccttgaatcaaattcgtattcaggtgatgaagacctagacaagaccgataaaaatataaattcatgaaacacgaatggaaacaattccttatgaccccttgagaaattagagaaagtcctgccacagtatcacaagggtgtgggttattataaaacctatcgagacattatgccggctctgcgtacccacgatacggcactatttgatcagaccttacgtgcttatcgacagcttgataactcccaatgaatacaacaattgaaagttttaaaagcatcgtaaacaagttctaagtgccgttggatcaccgtattcaaacggttatttagagggaactattggcggaattaagaaagttacgaacgccacctttggctttcataattagtttaattatataaattgaatcaagatccaacttcaatgactgcatccaatacgacaaactgtgagaaaaaagcacctagaccaatttaagtccaggtacttcataacaattttatcaacttcacttgacgaaaagccattttcatatatttatctaatctgaatccgttgtttatcattcatttatgtttacaagaatacgcccgtgagaagccgtttcgtcttcatagtgttgcgccgcttttacatcgttgaatttaaaaattttgtttatgtgcgctttaagggtgccatttgagagcatttcaataatctccttatagcggttaggactaatagggttattgttaaattcgctataaatatcgattcgctgtttttgatatgttggtaaagcagaagtgaataaagttccaccttcgaacagtttattttcagcttgattaagcagtgtttcgctaccagctgtatcaaggacaaaatttacggagttattggaaattaaatcaatatcactgacaacttgagcgcttggaaagatactttttgtgtacttaaagcttcgtttagacgaaagaatggtaacatttgcttttagggttaatagcatctgatacaaatagcttccaatactacctgatgcaccaattaataagacaatgtcattaggatgtaccccaacgctttgaatcatcatcatggcagtatcagctccgccgaagatagttgcgccagcttctaaagatacattatccggcaacaaaaaaacataaggcggaattgatgtgttgataatttctgcgtaagtcccatttgggctggcaccaaccacgcgagtacctcttgttgggccgaaaatattattatcgtggattgtcccggaaaatccataaccaagaatctttggcagagagctagtgtgcatctgagtcaaaagccctttttcatttttgatatcccaaggcaaaacgggaacgtacttcacatctactaaagcaccgataatactacttttgggggtggaaatgttgacggtttgaatcgaatcaataccattatagtctttctgaattactgcatgcataaatattacctccattcttttgattaatgctaatttacgctgtatcggcaaattttaaaaataagaatactgattttataaatttgattgaaagcagcatactaaattacatggaggtgataataatgccaatagttatcttactaatagtcgtgtttggtattgcaaaaatatttactttaagttattggttagttttggaatggacaggaggaattttgacagtaatagtgactgttaaattaattatggctctattactgagaaaaaaattttgaaataataatggcctgattattagtgcttccttgaagactggtataaaacagaaataggaattaaagcgccccttgagtttggatttactcaaactcaaggggcgctttaattaggttttctgttctattttttattcgacggttctaaatacgactatttctttgtttcacagaaaaatcagaatactaatatcaaatatcatgattcgaattatgttgtcaggtttttagggcgtactatcgggttaatcaaaagaaaggtggaattcaaaatgaaattctcaactgtagatgaagcattaactcaattaaaacatggcggtttaattattgtctctgataacgaaggacgtgagaatgaaggagatcttattggattgggatctaagattactggagaaacggtaaactttatgattactcatgccaaaggactgttatgtatgccgctatccgcaaaacttgcagataaatttgaactaaagccaattgtagacaaaaatactgaaattaatggtacagcgtttgttactacttctgatggttcgtatcaaacgactggagtgactacgggtatttcggcttttgatcgtgccagtactattaaaaaatttgctgatcctagttcgactgtaacagattttgtgcatccgggacacatgtttccgctagttgctgtaaacggaggtgttcgagaacggagtggtcatactgaagcggctgttgaacttgcaaagttagctggagagccggaagtaggagccattattgaaattattaaattagtacctataccagatattcctctttaatcgataaaaatatatctttgcaattgaaacctgacaatcagattagtggtaaagtgtccggtttctctgaaaagggtggaattttaatcacaaataatgggaaaacgactgagtatcaaataggtgagatcataagtgtaaactaagtattggccattgccttagcttttttgtagtacatcaaaataaggagtctagtatttcctgttaatggtcttgtacattataggttgataaccggagagactagattgtataaagtcatttctttaaggaagtggcttcttttgttaagcaatgttagcagactaagcggatggacatagtcaggttaaattcaggtaatcagtgatcacgtgacagttaaaccaacacttgataccaagtattgaagtatcgcaaaagtgttggttattataaaacaggccttaacctcataattgagagacgcgcattgaattataattttgaaacggcctatgaagcccatcaaaacattatggcagctctgcgtacccacaataccgtgccatttaatcagtttttacgtgttaccatcaacgacaattaaaagttttagaaagcaccgtaaatgagttataaatgtcgttgaatcaccgtattcgaatggttgtttagaggctactattgacttaattatatcagccgcatcaagattcaacttcactagctttatccaatacgagaaaacgcaggcaacgaaaaagcacctagagcaatttaggtctaggcgcttcataacaatttcgtcaacttcacttaacgaagagcggttttagaatgatttagttttgtttacctttgacacgactattagtacgtagtcgtcgtgtctggtaatagccacatcgtcaccaagccaattagccaagctactaggaaaaagcccattgcagctgataattggtagccaagcaaccattggcatagtaggataagtgtgataatgatgccgataacgcgattgatgttggtcatgagagtgcccccctaggtggttagctaagaattaaacgaaccagtttatctgaattaataaatattacttgaattatataatgaatgatgtgatgtgcgccaaaatgtgcgttaatgtcttaatttaacgtacgaacgtcgaatattttgaataaaataaaaaacgataccgttagtgtttcggtatcgtcagtaacaaaagtgtactaaatcgaactatctgtcgtctcatagtccaccttgccaagttcaatctgaatcgtgatgtgggtcaatggaaactgggcactcaagtccttattcaattgttccaaaaaggcattattgtcagccaatgttgagcgacagaggtggacggtcatggccgtttcagtagtactcatgccccaaatgtgtaagtcgtgaatctggttgacggtgggctggctagttaaataatcagcaattgcttggcgatcaatgttatttggtacggcttccagtgaataattcatggcgtcccgtaaaagtccccacgtgccaatcaaaatcacgacggcaattagcagggaaactacggggtcaagccagaaccaaccagtcttcaaaatgatgaaaccggcaatgaccacgccaactgaaacaccagcgtcagcagccatatggagaaatgcgcccttaatattgaggtcgtgtttttggcccttcataaagagcagcgctgtaaagccattgataacgaccccaacagcggcgacaataatgacatcccattcagcgaccgggccgggattactaaggcgctggatggcctcgactgaaatggccccaatggcgactaataaaaagacggcgttgaatagggcggccaagattgatgagcttttatacccatacgtgtacttatcgttggcgcttttttgtccgagccagattgctaaccaggagatcagtagacccaggacgtcactgagattgtgtcccgcatcagcaactagggccaatgagccgctggcaaagccgtaaccagcttccaagacaatgaaggctgtatttaacgcgacgccaatcttgaaggcgctggtctgttgttgtatttgatggctgtgtgccatatgaatcacctacttcttagttgaatttatccttgttatggctataatttaaatatgaatgagcaaacatatgaatgtctgttcatgtgtattgtaacacgcttacatgacaatctcaattagaaattggagtttatgatggaaaatgaaatggaccatgaaataatcgtcaaacggttggccgaactgatgccaccgactgctgagctcaatcggatcaccgcaatttttaaggcgctgggtgatccaacccgcgcccgaatcatctacgcactggcagtatctaagctgagtgtgggtgaattggcgacaggattagccctgacgcaatcgaatgtttcacaccagttgacagtgcttaaacaattaaagctggttgtcggaacgcgcagtgggcgtaatgtgcactatcaattggcggataagcacattattagtattttccaacaagtagcggcccacgccgaagaggctggcaattaagttgaatatgggggcgtagcgctcatctggctatgtgagggccaactttcatgaattagcgttacgagttgaactggatgtaaacggcgcccataactttgaatggttgcccgctgatagcggattgtgcttagcacaccactgcgaaaggactaatttcacagtggtttttttgaatacattgcgattttattaattacctagttttataaactagatgtattgatatttacaccatgtgatggtatgctggtgtcaacaataaatatgaggtgattaacatggcacagtcggcgcgacagtatcaaataacaaatgaagtcctcaactcagtgactcatgggattgggattattttaagtatcgttgcatttgtttttttgatgctcaaggcatatgcggatggtcagcccctcgaatgggcggcgtttattatatatggttgttcgttgtttgtactatatacgtgttcgacgttatttcacggattatactttacgcgcgcccgcgaagtttttcgtatcttcgatcacagtggcgtgtacgtgctgattgccggaacctacacaccgtatagtttactggcaatcaaaggctggttaggctggacgatcttgttaacgatttggattttagcgattgctgggattacggttaatgctgtttggcctggacgtttgaaaaaggtcgaaacggtcatttatgtgttgatggggtggatgtgcctcgccggtggtcggcagttatgggaccatttaggtgtcactggcttctggttattagttgccgggggcgttgcgtttaccttaggtgcattactatatagtttcccacggattaaatatttacacgttatttggcacctattcgtgatggtgggaaccacgttgatgtttttctcaatttatttctatatttaaggatgactgtggggaccagctgctgagttggtcttttttttttagatgcgggagatttgagtcgcggatgacgtcttaaatgctgattattgacattttattgcgaaaagtttttcaactggacggtattcgaatcgtaaccattgcgtacgctcgttaagctgaatgagttatcgccactcagctaacaataattttgaaattaaatggctagatcgctgtagcatagtctagaatacgatttatttttgtcatcaaactgtaatcagccaggcgtatcttttgattgcctttttaaataaacttccgtagaatagtaggacaacgaaatttttagtgaggtgattaagatggcatacgggttattatttggtggcattttcatggaagttttagggagctttttcttaaagcgcgcaaacggttttcggaacttaataccaacgataatggtgttgattggatattttagttcgttagtccttgtaacgcttgcaatgcaacgcctgccgttaggggtgacgtatgccatgtgggctggactgggcacgtttgcaaccgttattttagcggtcgtcgtttaccgtgaacggctcagtctctcacgtctgagtggcttaattgcaatcgtagtcggggcgattttactgaacatttaaatcaagggggaatgatgatgcgtgcatggattcaattagttattgcgattggcgttgaaattgcggggaccagcttgttgaagttatcggctggatttaagtaccccttggttggaattgtgggcatgttactatacggcctagcgatttttagtttctcacgggcattgagcaaaatcccactgagtgttggttatgcaatctgggccggagtcggcacagctgcgaccggcctgattggaatttgggcgtttggcgaaatcttgacgggattgaaaacgttgggattcatggcgattattacgggtgtgattctattgaacatgcctgctaaggcgactaaaccggctactgcgacgccgcgcttggcacggtggcggacccggtttaaccggtaactaaaaagatcgagaatctgactgattttttaagcgattacgcttgaaatgcgccggttgattctcgatcttttttagttgttgtaattaggcttctggccagatttccttagccgtaccaatgactaacgccaacttggcccactgttgagcctcagttaactggttaccttcttcagttgaagcaaagccacattgggtcgatagtgctagattacgcaatggcaccttagtggtcgcagcttgaactcgttctttgatcacagtggtcttttccaattctggaaacttagaggtaaccagacctaatacgatgcgtttgtggtcatcatggttccaaatctggtctaacgcttcgaagccacccgcccgttcgttatcatattccaagaacagcccatcatagttaagctggccaaggtagggtgcaaccacgtcgtaactgcccgagaagaggtacgtggatttaaagttaccccggcagatgtgggtcgtgacggtcaagtcgctcggtaggtcagctaatgctgcgttaatcactttaacggcatcggtcgcccacttagtgtaggccgcgtggtcagcttcgggatcattgagtttgctaattaagaaggcccacgtcgtatcgtctaactgaatatagcgacacccaaggtcataaaaatgttgaatggtatcgtgataagcttgggcgagatcatttaaataggcatcccagctgtcatagaatttggtccaattgtcactccgattatcgcggaataacatagttggtgatgggatcgtttgtttagcgcgtacgccagcgggaacgattgattgtaagtattcaaaggcagcaaagaacggatggtcgggattatacgcgactttgccaataagttcagcgttatccgttcgagtatggtcccccttgaacttatagctttgatggtagtcgtacttgccaacaccagttaagccccaaaggaaatctaagtgccaccagctgcgtgaaaattcgccatcggtcacggctttgagcccgagcttaacttgttcagcgaccactcgtttgatttcagtgtgttggatttcaagttcttgatcacgcgtaatggtaccggcggctaattgttcatgggcctttttcaaactagcggggcgcagtaggctgccgacgacgtcaaaacggaatggggcggttaaagttgtagttgtcattaaatatcaaactccttaaattttattgggaacgaaaaaacgtcgtcctgaataatattaatcattattcaggacgacgttgggccgtggtaccacctgagttctaggctagtgaactagtctactcgatacagctgccaaatgattggcaattgctaacgcgggtaacggttgttaaaccggctttagttaatgctggttactttgttgctcaccagacactcaccaaaacgaactagggagaagaccatcttcattggttgtgccgataccgtttcaccaacccgatactcgctgaacagcgacaccaattactcatcttttaatcgttctttaattattgacacctatcatactggtaattattttaaatgtcaaatttaatttaaggccggaatcggtgggcgggattaatccatagtcatgctataatgcaagtaacatgcgattgggggcaaattatggatagaatcattcggttttttaagcgggatgacgttgacttgtacttaacgttggcgttattaatcatcattatttatttaatgcgcgggtttgcgacagttgttctattaacgacgatttttgcgtatttgggcattaagcttagtcggtggttaaacctccgaacgcacttaccttattggattgccgtcattgtggtctacgtcggcgtgattgcgttgtttatcggtgcgctatcgtacgcggcgcctaccctggtcgatcagttgaaggtcattccagatatgctggctaaagcaatcaccaatcacccggtattgaataagaatattgataaatgggtcaaccaagccattcatagtagtgaattgattcaaaacgggaaggcgttactcgtcaccggtattaaaggactgagtgaggttgggactggttttacgcacgtcttaatggcaatctttttgagttttatctttgcagtttcgcggggacgaatgatggtctttggccgccagttcttgcagtcgaagtttaaaaagttcttcacgaacgtttactatttaacgcataaattcgttatgattctggggcggattattgaaacgcaactggtgatttgtacgatcaatacgattttgatgacgattgggttcatgattattgggatgccaagtatcatggtgttgtcgatcattgtctttatcttaggcttagtgccggtggctggcgtgttgatttcaatgattccgctaaccttactggggtttgcgtcgggtggcttgattcgagttgtctggatcatcgtgttggttattttgattcacgccttcgagtcttatttccttcatccacggctaatggcggatcggactgatttaccagtctttgtcacttttattacgttgattattatggaaagtctattaggggcctggggcttgatcattgggattccaattgtttcattcttcctagacattttgggtgtgcagaattctgagccgcgacgcgtgacgtctcaaatagcgaaacgtgaaccttagtgtgattgtaactgtactttaccggtagcaggctttgtatgggatcgggtgatttatatgaacagtagcttgtgactgcgcgtaaaggttatcaaagacaattgtaagctggtatcttcgaagtggattactttcgaaggtgccagctttaattaattactgcttaaagatgctgatagtgacaattacaagtcagactgttagtgttaagctatcagcgttctaggtggtataaggttgacttattgcgactaagtgttagagtgagcggttggaatctgtttaagagggggcgattacgattaatcaatcaaataatcaacatcccgtgttagatggctggcaagaaattgaagctgaccaaattaagcgaatgcaaggtgcgttgtggcatctgttgggcaatgcgatagcatatttaagtctatttgtaatcgaactagtgcttgcaatgattggtcattcgcaatctttgcacgcggatgcgtttaataattttgcgggtattgtttcatcggggttgttatcgcttggtatctggggtggcattcataatcatcaaccacgtcaaagtaaagtgaccgctttaaacggctgggaggccgaacgtcgcaatcgattgatgcgatttcgtttacaagacttattcacgttaatgagtggggtcattatgttagttatggcggtacaagttattgtgagtggtgttagtaatttgtttaaatcacacaccgttcaagcagtgagcggtgtaactgtttggggagctgcaatcgcgagcatcgttatgttagtcgtctggtactttaatcgtcgcggtgggcaacaattagataattcgacgctattagctgcggcaaaggatagtcttagtgatgcgttaacgagcattggcactttaatctcattaagtggggtcttactattcaaatttgcttggttagatagtgttgcgagtatcgtgattggattctttatttttgccgctgggttacaaatttttcgggacagtgggttgcagctaattaattacagtgatccacaagttgaaaaaaattatattaatacgattcaacaaattgatggtgtgaatcaggtcaatgcaattgatgtccagtattctgggagcttagtggccttgtcgctggttatagcagtgtcaccacgaatgacagtggcagccagctttcagctcagtgaaagaatcgagcaagtgatgcgaaatcagtatggcattattgacactaaggtaatgtttatgccgcaaacataagtgtgttgactgatagattttaataaataaaagactagtttcaaggttgaattccttgaaactagtcttttatttatggttggcgcgaattccgttgcggcgtgcgggcatggtggaccgtcaaattcgttagtgtggcgtctgttgctggtttcgtgaacaaaggaatcgtctcttccaagacatcgctaaacgctaagccgtaccagatagcaggagatggggtgatgttttgtagtagaacgcgaccaccaattagtagtcgatcgaactggcccatagttgggttgctagcaaggtccatgatctgctgattctgaacgacaaatttaaaatcgccaacttgacgaggttgtgtgattccgtaacgggaatattggggatcgatgctgtgatctgcaattaagttcgtgacaatttggcgcaaatataaattaatgtgctgtgatttacggaaacctaagttgagttgaacttccacgatatttcgagtgcctagcatgtcaatgctgtaactacaatcataaggtcggttggtttcattaatggtaataaaccagtaaaccttagcgcgtttaggccgcttatctaaaatcgagtacagaattgaccgtttaacccggtgttgatggtcgaccttagccaagtagactaagttcgttgcaaatactggcaggtgatcatcgtggcttagctggatcagttgattacgataatctagcagactaatctgttcatttgcctggttgtaacgcaaacgccggcgattaccaaagaaccaaacgaccataatcaagaaaatgacgagggtcagccccaaggtcaaatagccaccgtgaataaacttggtcagactagccgttagaaagacggtctccagtgcgccaaagccgaataataaagctagcgccagcgcccggtggcccttcatgtgaatccactggctaagcaggatggtcgtcatcaacattgttaaggtgatggctaaaccatacgccgcttccatgtgagctgaagtttgaaatagccaaacgattcctaaggtgaccagacataacagccagttgatcgcaccaatataaatctggctccgaacgttactggggtgcttgataatcatacgtggtaagaactttaaaccgactgcttcgtcaactaaggtataagagcccgtgatcaaggcctgtgacgcaatgatggctgcggccgtggctaagataatcattgcaatttgaccgcccgcaggaaccatggcatagaacggattgacattggtggcattgcgccatgccgcatcctgataatgggttaacatccacgcgccctgaccaagataattgagaatcaaagtcgtgtatacgaacggccaagtggcgtcgatgttggctttaccaacgtgccccatatcagaatacagcgcttcagccccggtcgttgcaaggaagacactaccaagaatgaaaattcccattttattagccggattgaataagacttgtacggcgtaaacgggtgagaaagctttgagaatgacgggtgcctgactgatgttgatcagaccgaagatgccgatgacggtgaaccagagcaacatcatgggaccgaatgaccggccaacgacggcagtaccaaacccttgaatcataaagagaaccagtaaaataaccgtaacggttagaggcacgagccacgggtactgggaaaaagcccccagtttgggtaatccctttaagccttcaactgctgatgtgactgtcacagcaggtgttagggtgccatctgctaacaaagcggcgccaccaatcaacgcgacgaaaattaaccatttggcccggtgacgaaccagcgcatacagggcgaaaatgccaccttcatgatgattatcagcgcgtaaagcaatcaggacgtactttaccgttgtaatgagcatcaacgtccaaaagattaatgaaacactgccgataacataatcaggtgttgcattcttaagttgccccgcgtcattgatcagggcgttcataacgtatagcggtgacgttccgatgtccccgtacacgacgcctaatgtgattaacatgccaatcaatgaacgttcctgaatccgttgcttacgcatgaattattgacccccacttcaattagaactgtgactcatactatactagcttttttcaaaaggggttaaccagacaaactaaaaatttgctcatgttaacaagtttcaacttacgtttcgttaggtgaactttacttcaagttgagtacaataagtaatccggttgttcgtatttagaggataaaaaatgggccgtttcattccagttgataacgctgaaatgaagcgacccattagttttgaatttattagtctagtcaattatttctcatcagtggctgtattcgtcttcaactgggagtgtttaacggaatagccaaagtaaacgaccataccgatggctaaccataccacgaagcgaatccaagtgacaggcttcaggttgattagtaggaagacacaacagatgattgacatgattggtacaaacgggacccatggcgttttgaagggacgccgaagatctggttgtgttttacgtaaccgtaagatggagaaggaaactagggtaaaggcagtcaaagtaccgatattcaccagttcagctaagtcagctaatggaataaagccacccatgattgcggcaatcgacccaaacaagacggttgatttaagtggtgcaccggtcttggcgctaatatcgctaaagacatgggggagtaatccatcccgcgacatggagaaggaaatccgagtttgaccgtagagacagactaacattacagtggtcataccaagaatcgcgccaaggtcaatgattccggccatccaattttgaccggagtaaataagaacggccgagatcggatgatcaatgtacttggcaaacgtttcaaatgggaccacgccagtcatgatggctgatacagccacgtagagaatggtacagataccaagagacagtaacatggaacgtgggagtgttttggatggttccaatgtttcttcaacgctggatgaaatggcgtcaaaaccgatgaaggcgaagaaaacgctagaggctgcgccgaagacccctttgaagccaaatggtaataacggactccagtttgccggtttgatgaagcgcaccgcggtaaagatgaataaaagaacaacggctaatttaatcactaccatgacgttattgacgcgtttagtttctttgaccccgagagacaataaagtggtaatcaggataataatggtgaaggccggcagattaaaatagctggtcacaccagggacggaacctgcagctgccgacaaagcagcgggcagtttgaggccgaagcctgccaagaatgattgaaagtagcctgaccagcccgctgaaacggttgagacagcgaaaaggtattccaacatcaagtcccagccgataatgaatgcaacaatttcgccgagggttgtgtaggcataggtgtacgctgacccactttcaggcaccatcgcagcgaattcagcatagcagagtgaagcaaacaggcaagcaatcgcagccaagacgaatgagatcattaggccgggacccgccgtcaaggcccccgtaccagttaaaacgaagatcccggtcccgatgatggccccaattcccagcatcgttaggtcaaatgttttaagttcctttttgagcggactgtgataagtggctaacatggcattgatatcttttttgcggagtaaccgcgtgtgtgataaatccataatcatcgccccatttcgatgtgatagctttagtttaatcggttttgacaaagttacgatggtcaatccgaccaaaataaatattctgatgggctatagtgactaaaagccaaataattagacgcaatcgcgcgacatcctgcgacttcttattgattgtctgactaatcgtgattaattagctacggtattcaacgcctattaatagggtgatatagcgaacatggcggggattgtttttctgaaggttaacttaccttgtgattgcgattgttagtgggggttattgaaggaccttagaaaatatggttttggctcactaaatcgccacttgattgatgcaacctgaagaactggagagagtgagcggcttattggaacccttttttattgatatcgattatatgaataaaatgggattatgattatccttaaagtattttgatgaatcaaatttgataattaattttcttgcaggtaaaacagcctacgagagactgatgtaattcgtcccggccttccaatatcaacatttattgaccacatttgcataagttttattattccaaatacaatcttgattgcaattttgaaattaacaaatacgaatgatgttcattagttggtgacaatgggtttggcgtttgctatattcaaaaggagaacgcaaatcaaggcctgaccaatattaaaggccacttgaaattagtggactactgggtctgctgattgttgctggtatcgaagctagtgattgcaatgactggcagatcttgaatcaaaaaaggggatagcaagctgattggtttggtgttggtaataaaagtattgatactagtacgtctgcattcataatgtataaagcattgccagactatttccagataataaagttgggaggcattagtcatgtcgtcatttcttaaagcaaagaccgttacacattacgtgctttttgcaattatccttattagtagtttctgtttatacgggtacgttaaaaatcgtattgagttaaatcaagcgaggactgtactaacaacaatgttaaaaagcagtccttatgacgtgcgtgtcttgagaaacacaataatcaaggaagaatccggcccttttagcggcattatttggtatgaatacacatttgcaaccagccaaacattagcggaaagtaagaaatacaaaaagtttttgcatcagtcatcaaaaaatatgaccctgaaaaattgccccatcgtctatcgcgtaatcgtcagaccgccgactaaaagaataaagcattggacgggtgaaatctatctcgataccaatcaaaaactcagcgcaacgggacgttcgaattacgtccaagctttaagcgacaagtctttgcgtgaactaacgatttcataaaaggcccttaaccaggtggctccaatgatttagcttactatcggcctacattgaaaaatggggtaggtaatgcgttaactcaatcaggccatacaacagatgttcagaaggggtggtcgaatcgagttgtgttgattgtctaatcaacgcaacttttttatttgaggatttaacttggtcaaaaatatttgttatgagtttctccggtggtagcagaggtatactgcaatgattgaataaaccgatccgtaagataatgacccacaaaaaaacagctgggagacttcaccagctgcttcaaagatttgatttattaacgatgtcgtcgatagtaacggtagacgaccgctaataaaataataattagtaaaataccaacggccgctcgcggacccgcaatgtgttcggttaagtgaaacatgcgaatggggccgaggccgtgaattccaagcattgcaagcattgaacgcgccctccttaagcataattattagctatttaatgattaaatgcaaaaattatattcgcaaaagattattatctcactactatctgcggtaaaataaaaccatcattaataaattaggtgggtgcctccattgcaatatattcagccaattttctatacaattatcgttttaaacgcggccgcggcgttcgttaccgtgttccgggatcgtaatcgggacatcgcggccacttgggcttggctactcgtgttgatttggttgccgattattgggtttatcgcgtacgcctttgtcggtcgtaagttaccgaaaaaccggttattccggttacgtaaagagacgcaaattagactcgaacagatgattcagcggcaacgtgaagccctgggaacggaattgatgcccgcagatgcggtcactagctcggttcgtgggatggtcagtttattcttgaattccgatggcgcgttactaagccgtaaaaaccgggtcaagatttatacggatggacatgagaagttccatgcgatgttccaagatattgaagcagctaagaatcatattcatattgaatattacacattttataatgaccagattggaaatgaattattacaccttttagaacggaaagcagcccaaggcgtcgacgttcgtgtcttgtatgatccgtgggggtcgatgggcacgttccgcagcttctttaagcatttagaagaacttggtgggcatgctcgaccgttcttgggtgctcattcagcgattttggacttccgtctcaacttccgtgatcaccgtaaaatcgtggtaacggatggccgggtcggctacgtcggtggttttaacgttggtgaccagtaccttggtcgtagtaagaagtttggttactggcgtgatacccatttgcggatcgtcggttcaggagtttttgaattgcaggaacgtttcattcgtgattggaacgccaccgatgcggaacatcgaatcgtgccagacgttaatatgttcccagtcattcgcgttaaagggaatacttcgttacagatcgtctccagtggtccggacagtgatgcacaacagattaaattgggttatattaaaatgattatgacagctcaacaccgtttatggattcagtcgccatacctaattccggacgattccgtattagatgcgattaaaatcgctgcgatgtcaggggttgacgtccgcattatggtgccggacaaacctgatcatgcctttgtttaccgggcaactcagtactatgcccgggagctggcagatgctggtgtaaaaatctattattataataatggttttattcatgccaagaccatcgtgattgatggtcaggtggcgtcagtgggctcagctaatatggacttccggagctttaagctcaactttgaagtgaacgcctttttatatgatgctgatttagcacaagaattggaacggattttcttagaagatcaaaaaatcagtagtttgattaccgttcaagactttaaaaatcaatcattctggttgaagttcaagcagacattttcacggttgttatcaccaattttataattaaacaattgaatagatgatgcaaaaaaactgattttggaaagttattgactttcaaaaccagtttttttagtgttccttagtcgttcaagtacaattggcgcaaattattaatatccgctacggataacccaagcacttctcgtaaataaccaataccattgccgtagaggtcgtcgaaaacccgaaagaccatcttcatattgtcggcttcaacagccatggcaacgttgaattggctagctaggtcaccagcattggccttggtaataatcgtagcggtatccatactgtctgcggccatgaagacggcgttagtgagcaggtagtcctgcataatcgtttcacgggggacgtctagggccgtcataatgagcgcacccgcgacccccgttcggtctttaccagcagcacagtgaaagagtaccgattggtcgggctggtcgttggcgaggagggtcgcaaataaattttgccagactttcacggcatgactatctgtaatcatttgcgcgtatgtttgtgcgttgaaggaatcatcgacgaccattcgcttgatgagccgttttaaacggcgatcaaagcgacgattgtcagtgaacggatagacagacgtattaatatacttagtattcttgggataacggtctggagacatctcagcttcattggcttggcgcagatcgatatcataacggagtccgtagttatccaagtaggtgagatcgcggttagtgagtagtgacatgccaccgcaacgcagcagtttttgccacttgattgtctgaccagcggtgttctcataaccccccagttctcggaagttgataccgtgttctagtcgtaagacccgattgtgttccatagtctgattacctcgattagtgatttaactttattataaccgctttcattgccggtgtcaggtgtgattaacaagcagtcgttaaagtcacagccaccattttttaagtaggcatgttggtttggaaacttcacaacagaatcattgtcaaaatgactagccgtcacgacgaaaccttagtgtggtgggatttataaaacgatcgatgagattttgacatgaaaataatgagaaaacatcttgaaatcaaagcgctaaccgcttatgattgcggcacgtatttttatttagtatcaactaacgactatacaaaaggatggggacgcaatgggagcaaaaaaaggctggttggcagcaaccttctttgctggaacactattactcgcggggtgtgggagctccaaggcaagtaatcagaagcaggctaagactgaccatttcaactatgtgtatgtgcaggatcctgataatttcgattacaccgtttcggcaaagcagaataatacggacgtggtatctaactttgaagacgggttgcttgaacggaatccgtatgggcaactaactggcgacttagctaaatcgtggtcggttagtaaagatggcaagacgtacacctatcacttacgttcgggggtcaaatgggtcgatagtgaaggcaatacgcatggcaccgttaaggcccaagactttgtgaccgggctaaaacacgcggttgcggcaaagtcggagcaattatacgtcgttcaaaatagcattaaagggctcgatgcttatgcgacgggtaagactaaggacttctcaaccgtgggtgttaaagcacttaatgcgacgaccgtacagtatcggttgaataagcctgagacgtattggaattccaaactaacgtacggcgtgatgtatccaattaacgcgcagttcttaaagcaaaagggggctgattttggtaaggtgactgcggatagcatcctgtacaacgggccatacgtgcttgccaactttacctcgaagtccgtcttgaagtataaagctaatccggggtattgggataagtcgcacgtttatttaaaggcgattacgcttacttttgatgatggcagtaatccggatggcctttataaatcgtttgagaagggcaattacacctatgctcgggtttatccgggttcagctggatataagacggttttgaagcagaacaagaataatattctgtggaccagtcaggattcgtcagtctataacttcacttttaacttgaatcgccagtcttacaacgataccgccaagaagactgatcaacaaaaggcggatacgcgtaaggcaatcttgaaccagaatttccggttggccgttcaatttgcatttaataaagctgattacaacgcgcaggttaatgggaagattggcgctaataaggggttgcgtaatgaattaaccccaccatcgtttgtttcgattggtagtaaggattatggcacacagcttcaagaagatatgcagaatactgattttagtgatattaagttggcagatggtcaggacgggacttatcaaccgacgaaagctaaacagtattttgccaaagcaaaggccgaattgaaagctcaaggggttagtggcccaatccatcttgacttgccggtggatgaaaaatcatcgttaatcctgaatcaagctaagtcgtttaaaaagtcagtcgaagccacgttgggtaaacaaaacgtcatcattgatttacaactgttgagcgatgataagtataatgtcgcgactttcaacgcaacaacgggtaaaactagtgattttgatattagtaacagcactggttggtcgccagactatgacgatccgtcgacttacctcgaaatctataacccagtttcgggggcgaacttgcacaccctaggattagagccaaccgcaacggccggtggatcagcttccaatgcggccgcaatcaaagcagttggttttgatcaatacagtaagttattggccaaagctgaagccattaatactgataccgctgctcgctataaggcgttcgcaaaagcggaagcatggttgttgaatagtggaatcgtgattccgactaattcgggtggtgctgctgcgattgtcagccgaatcgaaccgctcagtggtccgtatgcgccatcgggaattggtgctggtcgctataagtttttgaaagttcgggagagtgccgtcacgacgtctgaagccaagaaggcgcgggcggaatggctcgcaaagcggaaacaaattgcggaagatacgccgacaaattaggtcgacccttgcgtgaaggaaagagggctagcaagactagcctttttttctgtatctgttattacgaacgtgttgagttatgaaggaagtggtgggtcgtgaagaaatacttgttttaccggatgttgcgatcgttgctgagtatcttcttggtcacaacgctcacttatatcatcatctattcgttagttccgcgacgtgatatttttaaatccgatccgatgatcagtaagctgagtaccagtcctgatcagttagtcgattacgagaataccgcttatggcaagatgaattatatcgactatctggatactaagtcactcctagcacaggcgtcaaatcgggggcaaacggtgacggctgcgcacactgcggtcaatattaaccgattgcagcagtgggcaacacggtaccactatgtacttcatcgctatccgaaaagtgggaattattatgcgacccgtgagttacccttgtggcaacggttggtgaagttctattcgggactgatccaggtcgatacgccatgggccattcatgatccggataatcctaagttaccacggtatttaaaaatcagccacgatccgattgtcggctggagcttgattgggtctggcacgcgctacaagtatcaattatatgtcaattcgatgtttccatacttacatgaaaacatcgtccatttgaacctaggaatttcctatccaacctatgctggcacacgggtcactgaggtgattggtagtcatcagggggaggcggtgacgcaccagtatacgtttgcaaatggtcaaaaaatgttgagcactgatgatgtctatacgcgtcagtatcagccgaccagtcggcaagatgcgacggcccgagcacaatatggtgacaattacactgcggtggtccaggagaatcatgatccgtcgatgattgggacttcctttaaagctggatttggagcactaatcattgcctatgtgattgcgattcccatggcaattttgatggcccgctataaaggcaagtggttcgacaaactcggtacggggattgtgactgccctaattgcggttccaagcttagcctttatctatgcgtttcggtacttcggcaatgccgtctttaacttgccggatacctttccaacaagtggtgcgagcgtactggcatcgtgggtgtcaccaactttgattctggggttactatcggtttcaggcttagtcatttggtttcgtcgttacatgattgaccaacagtcagcagactacgttaagtttgccaaggtcaaagggctgactgataacgagatttatcggaagcacatcttcaagaatgcttcattaccgatcgtacaaggattaccagggtcaatcatcggtttgattggcggtgcgacaatgaccgaaacgatttttgcaatgcctggcatgggtaagatgttgccggatgcgattttaacgcataataacccgattgtgattggactagtctttatctttacgacgattgcggtcttttcaatcttgctgggcgatatcttgatgacgattgtggatccacgcattaaattgacagcaacgggggatgattaggatggtaataggtcgagataaaccgcaatctgaaaaagtcgaccagaaccaaatcagtgacgcggactttgaatttgtaacgttgaatgatcaggccaccgaaaagatcgaaacgccgcgatattcttattggcgctccgttgcgaaagccttttttgccaataaactgacgattgcgatgttcgtgctgatgctgataattctattattggcgttcatccagcccttgttcagtggctatagtctgatgaacgttagtaacatcaatgattttggcgcacgctacaattggccgagctggcactactggttcggaacggatgctgatgggaagtctttatttgatgccgtctgggcgggagcccgcacatcgatttcgattggtgtgattgcgtcgttgattacgacggtgattggcgttgctgtaggcgccttttggggcaactccaagaagttagaccgggtgatgctggagatttataacgtcttgtccaatgtgcctaatttactgattattattgttttatcgtatacgtttggcaatggcttctggaatctgatttttgcgatgacggtgacgacttggctggatacggcgtattttattagggtgcaagtcatccttcgacgcaatcgtgagtataatatcgcctccaagacgctggggacgccgatgggacggttgatcattcgtaatgttttaccgtatctgacgtcagtgatcgtgacccaattgtcccaattattaccttcgttcatttcatttgaagtctttctgtcatttttaggagtgggactgagtgccaacgtaccgtcactcgggcggctaattgcccaatattcgccagatatgaccagctacccgtacttgttctggttgccggtaaccgtactggcgctgattaccgtgtcgttgtacattgttgggcaaaacttggcggatgcatctgacccgcggacgcatcggtagccacgtgttgataagtcaagaaagtaggaggatggtgtgatgaaaagaccagttgtattagctgttgatgatctttcggtgggctttcaagttcgcggacagcaattaaaagcgattcgccacgtttccatggcattatatgatcaggaaatcctcgcattggttggcgaatcaggatctggtaaatccgtgttgacgaagacctttacgggaatgttggaagataatgggcacatcaccggtggacgtattcagtacggtgacacctgtttgagtgacttgaagacggatcgggagtggaatcagattcgtggcaaggggattacgaccatctttcaagatccgatgacctcactggatcctatcaaaacaattggttcccagattgcggaagtgattatcaaacatcaaaagaagtcggctgcggaagctaaagcgcaggcaatcgagttgatgacccggacgggaattcccgatgctgcagagcggtataacgaatatccatttgagtactctggtggaatgcggcaacgaatcgttattgcggtcgctttagcttgccacccacaaatcctgatttgtgacgaaccgacgactgcgctagacgtaacgattcaagctcagattttggatttgatcaaacaattacaacgtgaatatcatttttcaattatttttattacacatgacctaggtgtcgtagctgcaattgccgatcgtatcgcggtaatgtatgccggccaaatcgtagagctgggaacctgtgatgaaatattttatgacccgcggcatccctatacttggagcctgttatcggcgttaccgcaactggccaccgctgattccggcttatattcaattcccgggacgcccccgtcgctatttcacgatattaaaggtgaggcctttgcgccgcgcaatcggtatgcgttagcggccgactttaagcaggaaccacccaaattcgaggtgagtccgacccactgggcgaagacgtggttgcttgacccccgggcacccaaagttgagaaaccggccctgattcagaatctacacgcgcgcctaattgccttgaccaagtcagaaatgcagattggtcagatacggggagggacgaccaatgactaatgaaagaaagccactcttagccgtcaagcatttggagattgcctttggccaaggaaagcgggaattcgtggcggtcaaggacgctaattttgacctttatcggggggagaccttggcgttggtcggtgaatcaggatccggaaaaacgacgattggccgcgcaattctaggcgttattccgaccaagaaagggacaattgcgtttcatgaacaactcattaatcagcacttagcggtcgctgcgcaacgggaagtgatgcgcaagattcaaatgatttttcaagacccagccgcgtcactcaatgaacgggcgacgattgaatatattatttcggaagggttgctgaattttcacctctttgattctgaacaggatcgccgtgatcaagttgagcagatgattaaagcggtggggttgctaccggaacatctttatcggtacccccatgaattctctggtggtcaacggcaacggattgggattgcccgcgcccttattatgcggccagagttagtcgtggccgatgaaccgatctcggcgctggatgtctcgattcgagcacagattctgaatctgctccggcagtttcaacaggagagccaattatcatacttgttcattgcccatgatctatccgtcgtgcgctttattgcagaccgtgtggccgtcattcacaacggtcgtattctggagcttgcaccgaccgcggccttgtttacccatccactacacccgtatacgcaatcgttattagccgccattccaatacctgatccacagttggcgcgacaaaagcaactcgtgacttatcacgaggcagttcacgattatgtgactgatccggctcaattcgttgaactagttccggggcattttatctatgccaatcgatcggagctggtcgcctatcgtcaacaactgtctgtgacgtaaggtcgacgctggccacaggtacgtcgacctaaaatcgatcaagtgaacgtaaaagcgattagcttcgtctgacaggtcttttcaattagatacttaacttaaaaaccaatggtaccttacttctcccacggatacttaccgttctcatccttaggggtattacgcatgatccgcttagttccctcgtccatctcgttacgccgcttcttacgattatggtgacgaacaattaggacaagaccaccgatgccacagtacacgatcattcgggtaaacatcttaacggtcccataaatggtcataatcattaacattttgcgtcctcccttgccgtcaaatctacttaagccgtgaccttagcaggcttaaagtaatctaacaatgcttgccactgtttgaaaacggcttcttctgaataacgcttggcattttcataggcctgagcactgtattgtgccagctgcccttgattcttcaacaattctaaaatcgttttggtcaattgttgcacatcgccgtctgtcgttaggattccactcttatgatcctgaataatatcactcgggccgtacttcacgtcattggcaaccattggtaacccatgggcttgagcttctagcaacatcaatgagaatccttcagctcgacttggcaaaagtcctaattgggcccggttgtaaacggcattgacatccgtggtataccccttgaacaataccacatcttccaagtgcgctgcagcaacttgtgcatgtagttgcttttcaatatccccgttcgcataaccccataattccaacttggcatcaggaaactgcttgtgaacttcaacaaaggcttcgattgaatgattctgttgcttttcaggtgccagccgcgcaacttgcacgacgaggtctttttgtcgttggtcaaacttcaccggcgcggcttttaacgtagcattatcaacatagccaaccggaatagtgaacgctggaatatccttaccaaagcgggcttccacgtccttagtttgttccggtgtcgcagaaatgaccgcgtcccaagccgcccaattattcagcgcattagcataattattgttcaaggtagaatgcataatatccttagcatcactcacatggttattatgtagatgcaagactttcttagctggtgtggtcatattgaataagccccaggcacattcaacggtccgatcacaaatgaagacattttgttcatcattcaactggttaagttcatcatagaagtaacgggtcagttcattcatcccattaaaagtatggctctgctcgttgtagttcaagacgcgccacgtgattcgctcctgaccagcgtgatttaacaagtgtaacttctccacgtgaatcaatccatccgggccaaagtacgcttcttgggcaatcttaccgtcccagtcaaataattgttcaagacacttaaagccccgcgtatcccaccaactcatcttgagcgtacgaccattaacgtcaaagtattgcacattgctaacagcttccgtaccggcccgaaggtaaataatcatgattaacttaccacgttccatgacttgaatctgattatccttccgggttttgatagcatcggctggcacttcaaagtcggccaaatcaaacctttgacgcttgaccgactgactaccacaaaagaagtcaaaaagattaacaaaatcagcatcggcaatgttggccccttcaagcacatcgtgcaaattcattgcgaatacgcgggtcacgattttagcggccacatggtgcttcttgaataaagtcagtcggttgatttccgcctgttcgattcctgattttgaaaattgcatgttatcgtttaagaaataatacatatgtgccctcctacttaatacccagtaattgttgccaacggtgccaaacttttaagtcagtttgtgacgtatgaagctttttaaaggcggcttcactgaatgccgtcaacttcttcgtatccgtcattaattcgatgacccggtcgcgcagcgccaattgattgccaggatcaacgatgaaaccgtcatgaccgtcatcaatccaatctttaggcccataattaaagcgataactaatcactggaatcccgtgactcatggcttccggcatactcattggaccaccatcaacaatatcggtattgagcaacagctgataatcatcataacgtgtttctaaatcaggatgataatctaataaatgcacattattcgtcaattttaattcttcaaccagcttattcagcgtcttaagatactctggatcgccgtagccgtaaaagtcacactgaatttctttgacctgttgcttaactaacgcaatggtccgaattaactgatccagttgccgatccggcgccagccgcccaacgtatagcaattgcttggggcgggccgtgattggccgtagtttactctgcgccaacggactcgtagttacagttggtaacactgtcaccttagctttagggaaccgcgtccgcagatgctgagcctgactttcagtagctgtaatgaaaccatcaaagtgttgcaaattatcgaaggccggtgttaagaacccgtccaacggggaatgaattgggtcattaatatccttcgcctgataaattggaaccgtcacatacttgtgagaatcatcctgaagttccaacaacggcttcacactggtacctgggcgatcactaatgaaggtcgtcgtttgcttgtccaaatgactgagttcggccaagaagaaatgaaataaatggttcgcgtcctggaagaagcgctccgcttgatcacgataattctttaaaatcaaacgtgacgctagcggattaccgttagtgtcaggtacatagtactgctcaataacggtctcgccttgtagattataaaaccgttctaaaaccagtttaccgttctgaccaaaatattgtgtactggacttgaagcctcgccaatcccacaggtcagttgaagataagttaccttgattgtcgaagaattcttggtaaaagacgcgcccaatcgttccaggaataaagccgacgttgctaacgtgttcatcaccattaaaaattttgctaaagttggcacccacttctaccgcatattcaactggcagatgcatgtcatcagtatgcagaactttagttggcacatccgtggtttgttgaaagtaatcaaacatattcagcacttgctggtttgctaactgaaaagttcccatggtctgatgtagcaaacggtcatacatcttagtcacaatctgggctggcgctttatagtggttaaataatttcacccggttgattgccgcgtgctcaacactcgaattcttgcctaaaatatattcattaatgaagtaaaacatacagtcaccctttctgttacctagtattatgcttgtcgatatgtgtagttataatagttgatcaacccagataagaagtgttcacaatcgtcaatccgtgtccggaaactgtcatcacgtgcatagaatccgccaataaacttctgcggatgatataaatacattgctatttcagcataccatgcgccagtttgaatttcatagctagcccgttggtcagccaattgacttaattttaaaacatcatacggtgcaagcaggtcatcatttcctgactttttaactttatataccattttttgggacgcattaattagttctagtaacgttggcgatgcatgttttcgtttttgaatgtagtttaaatgcgtaaaaatattctttgcacctaaggccatatacgcacgggcttctggaaataggtcaagcgcaccattcacagcgtacgcaagccaatgatcatgatattgcccataatctaacttaaccatataatccaacatctcactaatcgttgcttcaatctgtatacttggatcaagttcatacatgcgtgtcagcgcaaaaacaatctcaccatcgtagtaaatcgtgcggaacttacctttaggcgctaaattgacatccaacacatgtacaaatcccgttgatgagttccaaaatgagcgaacccctttaaacaactgttttaatgtcggcaagaatatttgatcatgagtcacttcctgatatttacaaattgccaaaatgagcattgcttgggcacccagctttagttccccatgatcgttgacatacgctgcattatcaatcacaactagtgaagcatcaattccccactgaattgcaagcttagctttccggtaactttctgagtgttgcgaaaactgactagtttccagcaatgcataaatcgtggagaaatgtcttaaaatattgtaacttgagagcacacgttgtcgtgcaggaaaataaccatatataaacttgccatccttgtctaactgattgattaaatacgcttcaccgtcttctatcactttcttaatttctttacgcttattcgtaattgttcgaattccagctgtaaggaaaccatcaaccgctaaaggtcgaattttttgtccatctgagaatatggcggcagttgtaaagatccaaacattctgtgcgccgctaatatcgattgtaggattagactcacgctctcttaaataattctcaatttgatgatagtcagcccaagattttgcaggcggctcaccgaccacaaaatctttatcgggcttaaaaaagttctgtccatttatttccatttccagtaatgcatgcttgaaatcagcatcaaaacttacaccatatcgccaataattcatttttggaactttagcgagcttcgtttcgaagatacttcgccttaacttttgcactgcctgaacaagatcaattctcacccaactgttcttaggtgctgtattaagatcgttagcaactgtggtccacacggtattaaaagccttgtcccggtaaaacttgacacttgcacgatgccgccgatcagagattgagaccgccaaaaccaccatatcattttcatggctttctaaatttccattatcgataagcgcttgctttaatttctgaataactgatttttgcatactttaacctcatttataatttctattatgtatgccaaaacgggcttattcagcccgtcttggtcaatagttcaattttacatcgagcttcgttgacagtgccaacaaaatcactttaaattctaactattttcgctgatcttcatcttcatctttacgacgacgaccgaacaagaagaaccaccagccgagtccagcagctgcagccgcggtcaacaagccaccgaaaatcgttccggcattattacttgtatcagatgcagtcttaccattctcgtcagtattacttgagccgatcttatcatcagcactatcagtatcagctgacttcttatccttatcagaatcattactactcttcgaatctgaatcagtctgatcagaagttgcatcaacgtcttgagcgctagcagcggcataaaccactgatgtagcagcagttgctgacgttgttgcagcaccgtcactggatggtgtcgtaaccgccaacgttgcggctgtggccgagacaccacttgttgctgcagcactcaagctagtcgtacttgtcgaagcagcaccgttgctagaagcagtcgatgaagttgtcgtaccagtgccagtacctgagttatttccagtagatcccgtcgtattgcccgaacctgatccagtatttgaactggaacttccatctgagccagaattactaccattgccagaattggttccatcatttgaatctgaatctgtgattgtatcggagtcactgtcgctattcgaatcactgtccgagtctgagtcgctgtctgagtccgagtcactgtccgaatccgagtcgctgtccgaatccgaatcactatccgagtcggaatcactgtcagagtccgaatcgctgtcagagtccgaatcgctgtccgagtccgaatcgctgtccgaatccgaatcgctgtccgaatccgaatcactatccgagtcggaatcactatccgagtcggaatcggagtcactatcggaatcgctgtccgagtccgaatcactatccgaatcactgtccgaatccgaatcgctgtccgagtccgaatcactatccgaatcactgtccgaatccgaatcgctgtcagagtcggaatcactgtctgagtcggagtcactatcggagtcggaatcactgtcggaatccgagtcgctgtcggaatccgaatcgctatccgaatccgaatcactgtcagaatctgagtcgctgtcggaatccgaatcactatccgagtcggaatcactgtcagagtccgaatcgctgtccgagtccgaatcgctgtccgagtccgaatcgctgtccgagtccgaatcgctgtccgagtccgaatcgctgtccgagtccgaatcgctgtccgagtccgaatcgctgtccgagtccgaatcggagtcactgtcgctatccgaatcggaatcgctgtccgaatcggagtcactatcggaatccgagtcactgtcagagtctgagtcgctgtccgagtcggaatcgctatcggaatccgagtcgctgtccgagcccgaatcactatccgagtcggaatcactgtcggaatccgagtcgctgtcggaatccaaatcgctatccgaatccgaatcactgtcagaatcggaatcactatccgagtctgaatcgctgtcgctatctgagtcactgtcggagtcggaatcactatcggaatccgaatcgctatccgagtctgaatcactatcagagtccgaatcactgtcgctatctgaatcgctgtcggaatccgaatcactgtctgagtcggaatcactatcggaatccgaatcgctgtcgctatctgagtcagaatcactgtcagaatcggaatcactgtctgagtctgaatcgctgtctgagtctgaatcgctgtcggaatcggagtcgctatcagagtctgaatcactatcagagtcggagtcactgtcggaatcggaatcactatcagagtcaaaatcactatcggaatctgagtcgctgtccgaatcactatcggaatccgagtcactatccgagtcggaatcactgtctgaatccgaatcactatcagagtcggagtcactgtcggaatccgagtcactatcagagtcggagtcactgtcggaatcggaatcgctatccgaatccgaatcactgtctgaatctgagtcgctgtcggaatcagaatcactatccgagtccgaatcgctgtcggagtctgagtcgctgtcgctatccgaatcactgtccgaatcggaatcactatcagagtctgaatcgctgtcggaatcggaatcactgtctgagtcggaatcactatcggaatccgaatcgctgtcgctatccgaatcactgtctgagtcagaatcactatcagagtctgaatcgctgtcggaatcggaatcactgtcggagtccgaatcactattggaatccgaatcgctgtcgctatccgaatcactgtctgagtcagaatcactatcagagtctgagtcactgtcggaatcggagtcgctatccgagtctgaatcactgtcagagtctgaatcactatcagagtctgagtcgctgtcagaatcggaatcgctgtcgctatctgagtcactgtccgagtctgagtcgctgtcgctatccgaatcactgtcagaatctgaatcgctatcagagtctgaatcgctgtcggaatcggagtcactatctgagtctgaatcgctgtctgagtctgagtcgctgtctgagtcggaatcactatcagagtctgagtcactgtcgctatccgaatcactgtctgagtcggaatcgctgtcggaatcggagtcgctatcagagtcggaatcactatcagagtctgagtcactgtcggaatcggaatcgctgtcggaatccgaatcactatcggaatcggagtcgctatcggagtcggaatcgctgtcgctatctgaatcactatcagagtccgaatcactgtcggaatccgaatcactatcagagtcggaatcactgtcggaatctgaatcactgtctgagtctgagtctgagtcgctgtccgagtcggaatcgctatcggagtctgagtcactgtcgctatccgaatcactgtctgagtcagaatcactgtcggaatctgagtcactgtcgctatccgaatcactgtctgagtctgaatcactatccgaatccgaatcactgtcggaatctgaatcactatccgaatccgaatcgctgtcggaatctgaatcactgtctgagtcggaatcactgtcgctatctgaatcgctgtcgctatccgaatcactatctgagtccgaatcactgtcggaatcggagtcgctatcagagtcagaatcactatcggaatctgagtcactgtcggagtctgagtcactgtcgctatccgaatcactgtctgagtcagaatcactatccgagtcggagtcactgtctgagtctgaatcactgtcagaatccgaatcactatccgagtcggagtcagaatcactgtctgagtccgagtcactgtctgagtctgaatcgctgtcagaatccgaatcactatccgagtcggaatcactgtctgagtctgagtcactatccgaatcggaatcactatcggaatctgaatcactatcggaatctgagtcactgtcgctatccgaatctgagtcgctgtcgctatcagagtcggaatcactgtcagaatctgagtcgctgtccgagtctgagtcactgtcggagtcagaatcggaatcactgtctgaatccgagtcactatccgaatccgagtcgctgtccgagtctgaatcactatcggaatccgaatcgctgtcggagtccgaatcactgtctgaatccgaatcactgtctgaatcggagtcgctgtcggaatccgaatcactgtcggaatctgagtcgctatcggagtccgaatcactatcagagtctgagtcactgtctgaatccgaatcactatccgaatccgagtcactgtcgctgtccgaatcactatcggaatctgagtcactatccgagtctgaatcactgtcagagtcggaatcgctatcggaatccgaatcgctgtctgagtcggaatcactgtcggaatcggagtcactatcggagtctgaatcactatcggaatccgaatcgctgtcggagtccgaatcactgtctgaatcggaatcactatcggagtcggagtcactgtcgctatccgaatcactgtcggagtccgaatcactgtcggaatctgagtcgctgtcggagtccgaatcgctgtcggagtccgaatcactatcggaatccgaatcgctgtctgagtcggaatcactgtcagaatcggagtcactatcggagtctgaatcactatcggaatccgaatcgctgtcggagtccgaatcactgtcggaatcggaatcactatcggagtcggagtcactgtcgctatccgaatcactgtcggagtctgagtcactgtctgaatcggagtcgctgtcggagtccgaatcgctgtctgagtccgaatcactgtcggaatctgagtcgctatcggagtcggaatcactgtcggaatctgagtcgctatcagagtcggaatcactgtcagaatcggaatcactatccgaatcggaatcgctgtccgaatcggaatcactgtccgagtccgagtcactatccgaatctgagtcgctgtccgagtcagaatcgctatccgagtctgagtcactgtcggaatctgaatcactatcagagtctgaatcactatcggaatcggagtcgctgtcggagtcggaatcactgtcagaatccgaatcactatcggagtctgagtcactgtcgctatccgaatcactgtcggagtcggaatcgctgtcagaatcggaatcactatccgagtcagaatcactgtcagaatcggaatcactatccgagtcagaatcactgtcagaatccgagtcgctgtcgctatccgaatcactgtcagagtcggagtcactgtcgctatctgaatcactgtcggagtcggagtcactgtcgctatctgaatcactgtctgaatccgaatcactatcggaatctgagtcggaatcactgtcagaatccgagtcactgtcgctatccgaatcactatcggaatctgagtcactatccgagtcggaatcactgtccgagtcggaatcactatcggaatccgaatcgctgtctgagtcagaatcactgtcagaatccgagtcactatcgaaatctgagtcactgtcgctatccgaatcgctgtccgaatcggaatcgctgtctgagtctgaatcactgtcggaatctgaatcgctgtccgagtctgaatcactgtcgctatctgaatcactgtctgagtcggaatcactgtcggaatctgagtcactatcgctatccgagtcgctgtcggaatccgaatcactatccgagtctgaatcactgtcgctatcggaatcgctatccgagtccgagtcactgtcagaatcggagtcgctgtctgagtctgaatcactgtcggaatctgagtcactatcggagtctgagtcgctgtccgagtccgagtcgctatcggaatccgaatcactgtcggagtcggaatcactgtcggaatctgaatcactatcagaatccgagtcgctgtctgagtcagaatcactgtcggaatcagaatcactgtcagagtcagaatctgagtcgctgtcgctatccgaatcactatcagaatccgagtcgctgtctgagtcggaatcgctgtcgctatccgaatcactgtcgccgtcagaatcactatccgagtcatcttcactaacattagcagctaaatcagcatagtagcctgcatcatcagcggcacttgaagccttccttttagcttcagacgcttcggacgctttctttttagcttcctctgcataactggaagcagccgagttttcgccggcagcttccgcagaatctgcatttgattgggcagctgccgcattagaggctgcagttgaagcagctgttgcagctgactgtgcatcagaagctgctgccgttgcttgttctgcgtaggagcttgcttctgagtttttacttgcatattcgcccgcaatgttcgcataagaactagcaactgaaccatattccgtcgcttgatttgcgtagttagatgcttcgctagctgcagaatctgccgcttcagttgaaacagcattaacagtcaagtaagcccggcctaaagttacagttgtcgtggtagtagtcccgttagtcgtattggatccagtaataactaggtagtaataaccggattgccctactgtcagatccgacagattaagtgtcgtaccagtctgaccactcagcgctgttccagtaccgtccgctgttgaagaataataccattgataagtaacattagtcccagtacccgtagtcgaaccatctggaacccacgtcaaatcacttcctgcatcaacagacgtatcctcaaggccactaccaattgtaattgtctttgaagatgaatagctagttccgtctgcatttgtaattgttgctgtgattgtcaccgttccattagacacaacggtcaaaaggccagaagcatcaattgtcgcaatgcttgaatcacttgtcgtccagctaatcgttcccgtagcattctcagggttagtcgttgatgtaaactggctagtaaccttatcgtttgagccactcgaactgttcgttggattaatgacgtaatcatcaccagctatggaaatatttgttgctggaatattgctactataaacatctacttcagctaaattacttgcaaacgtataaactggaaatgcgcctcccaagagccaagaaaacccttgtacggcttggaacagcaatgatccagtatagcccgctttgatagtaactgttaatgaactactagttgatagtaaaccagcattgtcactttgggaatacgattcaagataatcgctggcatcatctaaggtcatccaggtgccgttgacttgaacataccaagttgtttttgatgatagtgcaaccccacctagtcctaatgctgacgaagctgacaaggtaaaggtcccaccagaaacggtcgacgtcactgctgcgggttgagaagtcatcccaccagaaataacaatccctagaattgtcgttgcattacccgtattagtgcttttatatgaattcgtattgtttgaataattcgtcgcgttgctagccgccgtactacctaaagccgcattggatgtagacaatgccgcatatgaggttgcttcactagctgctgctgaggcattggtcacatatgagctggccatagcataatcgcccgcagctactgccgatgaagcctggcttgtatactgagctgccatttccgcagctgaagttgcggccgccgctgcacccagagttgtcacggcataattattagtttgtgcaacgtatgagctacccaacgtggtgtttgacgcatactttgcacttaatgaactcgcgacactgattgcgttcccggctgccgattcagctgctgacgctgcgctagaagcagccgttgcaatcgaattataataactggattgtgcttgcacgaccgtttgggtaatcgcacttgccgcactcgaagcagcattcaattgatctgttgcataagtcaaacgcaaagccgcatagctttgttgcaaggcagccgaattataattcccgtccgctgcatatgaagcagcaaggcttgccgcttcactagctgccgctgcgtatgaactagccgctacagccgcagaacttgccgctgcattataactgctagttgcagtggtattaaatgaagaaccagcaacgttatatgcattagcagcgttggccgcataggatgcagctagcgaggcttggtcaccggccacatttgccgatgacgcagccatactagcataacttgatgctaaataatcagcagcggtatcaccgccatcttcattaaccgcatttttcaaagcagtatcgagactagctgctgcctcagatgccgcactacttgcagaactagcatattcggttgcaacactcgcataactcgatgccattcctgcccagatattagcactagtatacgccccttcggcttcataagaagcggccgaagtactggccatagttgcaatacttgctgcttccgaagccacactcgcatatgagctagctgcgttgtatgaagaattagcctgtgacgtgtagtaactagctaatgagcccgtcaagttagctgaagaactggccaaactgatcgcactacttgcagcgacggcttgagaggttgccactgaggctgcgctgttggcttggctggcataactgctggcaatttcagtgtaagttccttctggattagtgacaacaatggtaatcacattaccagctgctttaaaacttgaagtcaagattattgctgtaacccgcttaccactcacgactgcttgataataatacgtccctgaagtagttgcagttgttgtatacgttgccgatgttgcaccactaatggtcgtccaagttgtcccatccgttgagacataccaaacataagttggtgtaccacttactgaataccctgaatccaaacccaccttgttggtaattgtcacagtatctccagtcgagacactttgcgttgccgtactcgtcgttaaagtcgcattggaactaacggtttgttcattagcgacatccgtcgaaaacttagcagctaaagtcgcgttagactcggcagttgcagcgtaactagcagccaatgaagatgccgattgggccacccgagcgtatgagtccgcggtggcaggatcactagcactgacagcggattttgcagccgtacttgcgacggcgtaggctgaggaagcagagctagcggccgttgcagcacttgaagcataagctgacgcttgagtaccagtttgcgttgctgccacactggccgcacttgaagccgtactctttgctgtattcgccacgtttgcacttgaagaagccgcactcgccaaatcactaattgcagtactgttggcaaaactggctgccgaactagcggtgctagtagcggtgctcccggcggcatattgaccaagcgcctccgttgcggcggaagaagtaactgcataggcagtactagtggcttcatagtcattatttgccgcattactacttaccgcggcataggctgaggaagctgccaccgcagcggtcgttgcgttaaccgcggccgttgaagccgcagctgccgtgctagaagcaacggtgtaagctgaggtaacggccgtattatttttgtcgtattgcatggctaagtatgcactgttggctgcttcagctgccgagctggctgctaccgtggctgcagatgccgcactagatgcggcggaataattgctacttgctaaattaattaagccttgggtagcagcactgctggccgttgaggtggccgttgaagccagggctgcgtatgaactggccgcactcgctgcactatatgctaaagagtttgcaccagagtatgcgattgcattatcaacattggaccccacaccatttgtcaatgcgtctaagtacatgtttgcaatactattgtagtgccgtgacaaatcagccgcgttaagcgcttcttgataggcactttgggccgcactcactgctgcttgcgtcgttaggttattgaccaaactagcatagctgctggcaagtgtggcgtatgaaccagctaatgaagctgatgatgaagccgccttagctgcggtactatcggtatgtgagctggcagccgataccgacgagtaagctgcaatggctgccgttgaagccgccgtacttgcagacttagtcgtgctggcaacactgcttgctgtcgagacagtacttgccgctacgctagcactgcttgacaaactcgtcgtacttgagctagctgcggaagaactgctgctatcagttaaactcgatgaagtagcgcttgacgagctcgaactactacttgaacttgcgctggatgcgctcgaactagccgttgaaacactgctactactagtacttgatgtacttgtcgcattagtcgtacttgtttcgctcgcagaacttgcgtctgaagcactgtcatcgctgcttgaactatccgatgaagattcggaattactgttcgaggcagtttcactcgaagaagatgccgtagacgagtcactggtagtactagttgacgtactacttgccgttgcagcagctagtgccgccgcactcgctgctgcagaagacgtatccgcccccgagctggcactactagtggcactacttgccgtatcgctactagtatccgccgaaaccgtatctgcatgagatactaactgaggtgcagcagtcaatacaaatgatgccatcgccgtaaatacccaagtacggccgactttaaacatcttgtagtgaacttgcggatctcccctaaaagatttatgtctcagaaatttcatggttttgccttccttctctaacctaatcaaacccgtttatatatgatacaaaaaacacatatatagcatcattggtatacaccatcaatcgttaggctatgcactcataatactatgattatgttttgttggcaatagttgataccgtcaatcttgttacacgttttccattaattttcctaaaatagttaccaaataaataatattaatgaaaacgagtgtaataggcctcataaagcccattacactcgtctaacaacttaaaatttatttataacacttatggaaattttattggaaatttttcagattttttttacgtcaatatcaaataaacgacaaattatgagtcgctttgacaattaatttgttgatactaagccgactaatcctgattttggtttaaatcagccgcgtgttgtgctgccgttttttgtggtccgcgatccaaactattcacaataaaggctagaataaccaaaccaaggccaatcaggtagacccaatgtaagcccgtatataagatacgatgaagtgtcggcaacaaatgagacggtaattgcgttgctgtctgtggattgatcaacttgttcatcatcgccatgttcgttcctgcatggtgctgaataccttggttcatcccaacgttcaacgcaattccaaagattgaaatcatcaacgtttggccaatcgttcgactcaacgtattgaaggacgttgcgacgcccacgttctcagctggcacaaggtgttgcgacgtgacggtcgttgctgtaattgtaattccgaagcccacaccaccaatcgctgtgatcaggaagaaccatgggaaagcagtattaactggtaaccacgctaagcaaatgcttgtcacgagaatgaaagccaaactcagatacaaaatccgtcgcggcgcccactttgccaataaccgccccgtcacgaatgacccgacgatccacattaacgagctcggtgtcactgcgaatcccgccaaagaagccggtacacccagtatcccctgagtccaagttggaatataaacttcaacggccattaggaagccactgactaaggccgccacggcattctgaataataaacgtgtggtttttgaataaatccatcgaaatcactggttcatccgtgcgactttcacgacgaataaatagccacaaactgagcgcactaatgatccaagcagtcccaacggccacccaactgatagtggcgtttcccaatagttggaagcttagcatcaagcacagcaagaagagcatcagccaaaagctacccaagtagtcgattttcacgttattgtgacgtttgggttctcgtaaataaaattgaaataggaaaagggtgatcaacccaactggcacattaatgaagaaaatccaatgccagctgagcttatcgacaattagtccaccaatcagcggtgccagcactgaagcaatgccccacgctgaactattgaagcctagcactttggcccggcgttcgaatgaataaatatctgcgataattgtcattgagactggcattagcgccccggcaccgatcccctgaatggcccgccaaaaaattagcaccggcatcgaattagacaaaccgctcatcatagacccgataataaaaataattagtccggcttgcatcactggttttcggccgaccaagtcagtcagctttccataaattggcgtcatcatcgcattagtcaataaataaattgagaaaacccaattcatcaatgaaaccccgtgtaaatcaccaacaatcgttggcaaggcggtcgacacgattgtcccttcaatcgcactcataaacgtcgcgacgtaaatggcaaccgtaaccgccattacgttagttttacgctgttgcatcttagtaattctccttctctatcaatcattttaaaaccccgtgcatctaaaatagcccgcaaaaaaaagcgaccttgaaaaaaggtcgcttttagcgtcgagtacctacagaccgtaacgaatcaacgttaccgcattatttaaatgctgcttttaaagcatccactttatcagtatgttcccatggcaaatcaatatcggtccgaccaaagtggccgtatgccgcagtttgccgataaattggccgttgcaaatcgagcattttgataatcccagctgggcgtaaatcaaagttttcgcgaatggcgttaatcaacgcttcatcactaaccttcccggtcccggcagtatccactgcaatcgaaactggttcggcaaccccgatggcatatgccaattgcacttcgacctgatcagctaaaccggcagccacaacgtttttggcaatgtaacgagcagcgtaacttgcagaacgatcaaccttggtcgcgtccttaccagaaaaggcaccaccaccatgatgggcaaaaccaccatacgtatccacgatgactttccgaccagtcaaaccggcatccccttgaggaccaccaataacaaaacgaccagttgggttcacaagatacttagtttggtcatctaataaatcagctggtaacacagccttgatgacttgatcaatgaccgtttgccggatcgtgtccaaatcaacatcaggatcatgctgagtagacaagaccaccgtgtcgattcgcttaggttggttgtcttcgtcatattcgaccgtgacttgggccttagcatctggacgtaaccacttaatggtaccatccttacgtagcgctgcaattttacgcatcaaccgatggctcaatgcgattggcagtggcattaattcaggggtttcgttgatggcataaccaaacatcatcccttgatcaccagcaccgatttgatctaatgggtcagcatcgccagaacgcgtctccaaggaatcatcgaccccttgcgcgatatctggtgattgttcatccaatgagacaaggacggcacagttgtcaccgtcaaagccgtattgaccatcaacatagccaatcgacttgatcgtgtcacgcacgaccttttgaatatcaacgtaggccttggtcgaaacttcaccgaagaccagcactaatccagtcgtcactgaagtttcaacagcgacccgtgcttgtggatcctgggctaacattgcgtccaagatagcgtcactgatttggtcagcaatcttatcaggatgaccttcagagacagattcagatgtaaataagtgtctttcactcacaataaattcccccttgataatttcggttacaaggcatctaagcatcacttattcttcattgaacaagctaaacttatcctttcgggaacggctcataactatataaggttatcacaatcaccattttttttaaagatttctgtcaaattattgacgggaactgccccgaccggtacgattaactcattatcctaattagagagtgttgacaatatgattcgaatcggaaaattacatatcaaacgcgattacatcgccttggcgatctttaccatcgttcaaagcatcgttagttggtgggccgccctcgattacgggcgctcatttcaaacggcctcattttcagccgcgcagttaccactgattggctacaccttagccgtggccgccgcggtcttcattatcttagatcggcggattgctccccagtggagcctcattgcgattggaattaccgtggcctttgcatttaccaacattattgccaaggaatccgaactactgtacctgctattaacgtgcagtgcgtggttgctcgtgatggctgttccacgcttcggtatgcaaaactactttggtctagtcgttttcggcgtcatcatgacgttcacgatcccagtggccgtcttcgatttacaaaataactatttatcaactacttttctctggaagctgacccccatgctggctagttatgtcttcctatacgttccgagcttcagccgtcaacgccaaatcaatcaactgatttcggccatcactggcctgctacttgttatcaccatcttcctgcagccgctgacctggcaaacgatcgttgcaattctcatcacgattgctgtctggttcagtcaacagtcctttggccttactcggttacatctcatgatcaacgtagccgttcagttggcactgattttattactttattaatatctagataacaacaaggcgtctacctagtctcttaaactaggtagacgccttgtttgcccctatcaccggttcttaaagtgctgctattaactggcgccacttttcaataatcgtctgcttgctgtaacgagttgctgaattgtaagcattcgtaatcagttgtgcttgtcgttcagggtgctgtaaatactgacgaactttcattgtcaactcattaacatcattgggtgtcactaagtacccgttaacgccatcttcgataatatcttccggcccgtacgcaattcgatagccaataaccggcacgccatagctttcagcttccattgtggctagcgaaaagccctcttccacactcgtcattaaggcgaggcttgcccgctggtactcttctgccagattgggcaagaaaccccgaataacgatatttttttctagatgattggcctgaataaattgacgcatttgcatttcaatcttttgcccatgcccaaacaactgcaaagtcaggtcgggaaattcaccaactaaccgacgaaccacttccagttgatgtggtaattgcttttctggcgaatagcgcgccacactaataatccggtgcgggtcacgaccatcaattttaaccggatgaaccgttgtatagccgactggaatcacgacaactggtggtaaattatcatagcgtgccaataaatcacgcttttgatgctcggtcgacacaataattcggtgaaattggtctggatgggctaggacataccgatagaccgatttcaaatgcccacttaccacgtcctcaccaatccgtagatgcgtgctatgtaagactgaacacacgcgaattgcggggcgcgtatgacctaaggccgccgccgtttgtcggttacgatcacagaaatagacgtcatcagcagtggccaattcattgaagaagaatgtctgaaaagcctgttcggtattgaagaaaaagtctctttgttgatagttcttcaacgtaatcagtcgtagttttggctctggcccggtaatatcatactgtttgataattttgacttgcccttgtaaatcataatacacttctgtgtgcacttcctgatgtttcactaaaaagcttgtccggctcaggaagccccggttatcataaaattcgcgtcggactttaacaccctgattatcaaaataattgacataatccaattgttgtcgcccggcgtccacaaaatgaacgtacatcaaatattgaccatcggtatccaggacgcgaaaatccgtcgtatttggaacctgaatcaccttaaagtgacaaacagcttgccaatagtgcatccaatcatgatggattttagtcactgcttcaggcatcgtcccctgaaagaaatcatacaaactaaagcattttccttccgcaccaaagcgggccgcatgctcatgtaaacgcggattataagtgacatagacgcatcgagcctgataaccagtggcgtcaaatagcgccagtcggttcaactgtgccttttcaattcccgtcaatttcaatcctaaaccagtacccacaaaataatacatcacctagccgttcccttctcaatctgaaaaatcaactcatcctgtcaccgagttcaaaaacttcgagtacgcacggacgattgaccacttcatctgttatatctatacactatctttaccctaccatattttacgttactcgaccaagatatgaacagttttattgacatacaaaaatcgctagtcgtgaacaactaccgtatcagcagtgcccgactagtgatttttcaccagtttcaattaaattgctagccatacctagtgacgctcagcacgctaggtattgttttgctcaaatataattaaatcaataattagtatgtaacgaacaccccaagacaacttagatctcggagacacgcccaccatgaactaaaacaccgtcatttcttaacatttttcaaagcttggcggaatccgaaacactgagagcccgtgccaccgtcgcaatatccttcggcgttgtgcgacaacagccgccgataatgcgggccccggcggctaaccactgggggacaaaggatgcaaattgatgactcaaatgagtttcttgccaagtcttcgtcacgggatcatattgatcaccagaattaggataaacgatcaacggaaccgctacagccgccttcaaagtggctaacgctggtgcaatgttttccagcgtagtgcaattgacccccacagcgaccacgttcggctgggccgccacccactttgcggccacagctaatgacgtcccatcacataatgtctgtggatccttgatactaaagcttacccagtatggttgttgcggccaagtggttgtgattagttgtaccaaagcctgtacttcgtctaaacgtggcatcgtttctaatgcaagcacgtccaccccggcggccatgatcaacgccaggcgttcgcggtgaaagtcttgataggcactcggcgttaactgatatgcacccgtgtactcactaccatccgctaagtaagcaccgtacgggccaatactaccagcaatcacagcatccgtgacatgactagcatcacgcgccgtatgagcaattgtcaccgcctgttgtatcaattgacgcgcttgtgcggcagcaataccagcctgctcaaatgcaggcacgttggcctggtatgtattagttgtcatgatttttgcgcccgcatccagatagctctgatggaccgcttgaatcgcatccgggtggtccaacattgccgtggctgaccacagtgcgctattggttgccacgccccgtttttctaattccgtagccatcgcaccgtccgagacgactgggccccggttcaattgttcagttaatgaaagcattgcaataattgccttcctttctacttataaattatgttattctaatagcattgttgattttctaatcatagtctaatcatattaattctgcaagtaaggaaggccggtacattatgtcaaaacaaacccacctcagtcgccagatggaatcacggcacgtactgatgatttcgctcggtggcgtgattgggaccggattatttttaagttccggttacacgattcatcaagcggggccaattgggaccctgctcgcctataccattggagccatcctcgtctatctcgtcatgctctgtctaggtgagctgtcagttgcaatgccctacaccggggcgtttcacgtctatgcgaaaaaatatattggtcctggcacaggctttacggttgccatcctatattggttgacttggacgattgccctcggttcagaatttacagcagcggggctcatcatgcaaacgtggtttccgcacattgcgacctggatctggagcctcgtctttatggtggtcatcttcaccgttaacgccctctccgtacgctggtttgcggaagcggaattctggtttgccagtatcaaagtcatcgcgatcattgcttttattgtgttaggcggactggcaatggtcggtatcctgccacttcacggtcataccagtgccccgtttctgagcaactatacgcgtaacggttggttccccaatggttttggtggcgtctttacgactatgctaacggtcaactttgccttttccggaactgagctaattggaattacagctggtgagactaaggatccggcccacaccattccgaccgcaatcaaaacgaccctctggcgcctgattattttcttcatcggtagcatgttcgtcatggccgcactgattccttacaaacaagcaggtgtgacgcaaagtccattcgtgctcgtcttcaaagcgattgggattccctacgccgctgatttaatgaatttcgtcgtattgaccgccattatgtcggccgctaattctggcctctacgcgtctacccgcatgctgtggtcacttgcgaacgagggaaccattccaaaggttttcaaacgaaccacgaagcgtgatgtgccgttagtcgccctaattactagcatgctgggtggcattctggccctattgtcgagtgtctatgccgccggttcggtgtacctggtcttagtatccatttcaggacttgccgtcgtcattgtttggatggcaattgccctttcggagatcaacttccgcaaagcctacctgaaaagtgggcagtcgcttgatcaattgacttttaaaacgcccggctacccggtcgtcccgtggctggcctttatcttaagtgggctctcttgtatcttgatttggtttgaccctaaccagcggattgccttgtattacaccattcccttcgtggcgatttgctatctaggctactatctcaatcaacgttatcgacggacccacgccgcaaagtaagcccgttagtcatctcaactcaccaagtccacccagtaatcgccttttgatgttgacgacctaaaaacgaacatggtcatggcttttgctggcatttctgaatctacttttaaagtacgatccagccgacgacaccgatttttgaactgcaacaaaaccaaatatcaatttcagatctcttgctagcccggccagttgctagcaagagattttatttatttcagcagtaaattgattatcactagataatcgaataaataaaccattaaccccgtatacaagctgacgattatgctatgattaatttatcaagagcattggaggggtttctatgcacccaggattattactcgtcaatttaggctccccagcatccccacggactaaggatgtcaaaacatacttacaagaattcttaagtgatccaagcgtcatcgagatgccagccgcactctggcaaccgctgttgcgtggtattatcttaccgacccgttcttggcgttcggccaccttttatcaggatagttggctcccacaaggctcaccattaatcgtctacagtcaagccatctgccaacaagtacaagcagcattacccgattgggacgtccgactagcaatgacgtacggtcaacccgatatcggtgcgaccttgaaagccatggttgctgatgggtgtgaaaagccaattattttaccactttttccgcaatacacccagagcacgcacggcggcatccatcgtcaagttgaagcaactggattaccacacacctttatcgacagtttctacgaccaaccgacctacattcacttactagcaaccaaagtctggcaaagctatcaggcgcatcattatgatgcggtcatcttcagctaccacagcatccccactgcaatggtccgccatggtgatccctatcaacgcgaatgcgaggccacgaccaaagctgtgttggcggagcgaccagaattaccagctgataaggtcattacggcgtatcagtccaagttcggaccgatgccgtggttgaagccttacttaaaaaatgagctcatgcagttggtcgaacttggcaaacgcaacgtattagtagttacgccatcctttgtcgtggactgcttggaaaccctcgaggaagactacgttcaaaattatcaaacctttcgggcaagcggtggtgatcggtttgacttagtaccaccgatgaataaggataccggcttcagccaatttctggctgacctcgctatccaaaagcaggaggcgtcgaaccatgcaatcgcatcgtcatcaaagtcttgaagaaatcaatcagagcgtcgcggttcccgacgttcatcagacggccttttggcgcaaatttttagcctatagcggtcccggtgcactagtggcagtcggctatatggatcccggcaactggttgacatccctagccggtggcggtcagtttcagtaccggcttttagccgtgctcgcattagccatcattgtcgccatgttcatgcaaggcctggcaatcaggctaggcgttgtagcccggcaagacttagcacaagccatcgctagcaagctgccccggcccgtgcgttacgccgcgtggattttaaacgaagtcgcgatgatggcgactgatatgacgggcgtaattggaaccgcaatcgccttaaaaatgttattcggcttaccactacttgcaggaattttactgacgattgcggacgtcttagttgtcttgttgtttttgagatttggcattcggcgtgtcgaagtaatcgtcctcgtcgctattttgaccgtcggcattatttttggtatcgaggtgggacgggcccacgttcaatttggcaacgtgttgctcggcttagttccaacaccattgatcgtcaaaaatcataccgcactagtcctcagtctcggaatcttgggcgcaaccatcatgccacataacttatacttacactcatcgcttgcacaaagccggcgttatgattatcataatccagcccaagtcacagaagcactgcgcttcgccaattgggactcaacagtgcacttgattgcggcttttctcatcaacgcacttttgctcgtccttggtgggacgcttttcttcggtcacactaacgcgttagcgagtctgcaggccgtcttcgatgggttaaaaagtaccaccgtggttggcgcccttgctagcccggtcatgagctggttatttgcattagccctactaattaccggcctaatttcatccatcactagcaccttagctggtcagatcgtcatggaaggttatttacacatccgcttaccgctatggcaacgccggctgcttactcgcgctgtcacgctaattccgattctgattatcggtatgttagtcggctttagtgacgctgcctttgaaaacttgatcatttacgcgcaagtggcactcagcatcgccctcccctttaccttgttgccactagttgcgctgacaaatgacgccagcctgatgaagacccacgttaatcgcccagcggtaacgtggttgggatatggactggctggaattattacggtgttgaatatttatttggtgtatagcttgttttgagattatgcaatatattggcaatctaatccccgttatttcaataaggaccccattctgatagattcaaaatggggtccttatcttttactttgctaaaaactgacagaacttttgaagaagacagttgcacaaacaatgccagtcagtcatattcagcgattcagcagtcccgctaaagcaccaatcatgttggcctgattatgaaacttagcaggcacaatctctggctttgataaagtcgttccaattacaggatactgttgcagcagcgccgcatactgtttacggatcatgggcacaacactcggttgagcactgatgccaccaccgattgcgacggtcattacatccagtactgcttgaacgtttaagataatttgtgcgacctccataccataagcttcaaagatgcgttcagcatccgggttgccgtcagctatcgcggcaaacacctgatgaccatcatgtcgatcaggtaactgtaattggtgcgcaattgccgtaatcattttcactgcagaacccgtctcacccgttattttgaaattagttccagtcgttgcggctaacatcagactcaactcaccagcttgaaaatgactacctcgatagagctgattattaatgattaagccaccaccaaccccagttccaagcactaagactaaaccattttggcaatattgtaatgttccgcgccatttttcggctaaagccgccgccttaccatcattttcaaccgctactggaacctgataatggttttccaaagattcctgtaagttgcattgatccaggtatggtagtgcgccgccatggtgaatgataccgcgttgggggtctacttgacccggaacgctgattgccattcccgcaaagcgcccttgaaagcggtcgatagttgctgttaactggtgccaaaaatcatgcttatttttggcaattggcactgcatcaagtgactgctgcaattgaccattcgcatctatcagtcccgacttgaggctagtaccaccaatatcaagacataaataattattaatcatgcgtaccacccgtaatgttagcctgcgcttgatgaacatgtagataatgtccgagcgcataggcagctataagtagaaaggcaacgccactcaacatcataactccccggggcgtgccatgaccaactatattagccagcacatccataatggtttgtgagacaaagcaaccaatattgaccaacactaacacaatcgtcgttgccaagttcaaggatgattccggggccgcccagtccaaccaattgtataagtatgggacaccgataccaaaaccaaagcccagaatcacaaccgcaacgaataaaaaaacaatattagttgcaactgcaatcagaatgaagcccacagcaactagcaaaaaacccaacgggaaaatacgatcatgtaatcgtttaaagaagaagccaaaactagcgcccactggaatactgaccaatgttgataatccagcaatcaaggcagccgtactactggtccccataccgtttgcgacgatcaagcttggtaattcataagaaaacggcatgtagaacataaagactaaaaacatcaacactgcaattaccacgactggcatattgatttttcgtgtgactgtcgctgcctttttggattggctggctgcctgtataactggccgtggtaacggcacaaacaatgtaaataaaatcaacgcgggaataacgagtaggtaaatggcaaaggcggcatgccaactgatcgttactaaataactaactaagaatgaggcaatggcggccccaacacttcccatcacgttctgatagccaatcatttgcgccaactcattttcatcacgcttatagaattgtggaatcaaactaacagccagtgagttgaatagcccaatcccagcaccgattagaaaacgggaaactaagattgcactgtagaccgtggcgtacattggaaaggtccctgccaatagggtgacaaccaggccaataacaatggttagtttttcatgacaccagcggaccatcaacggactgacaagcagccccgccacaattccaaaattaggaatcgttgcaagcgtctgaacaccggcctgttgaattcccgggaaagcatggtacatcaacggtagcgccgaagaaatttgcggcgccatcatcaaaaataatgaaattgataataatgaaactttaaacaataaatgattttgtttgtccttcatcatattttcctccagattagatcaggccatatgttcctgcaaaaagcgcatttcatcatccgtcgcttgttgtgctaattcatccttttgactaatcagaaaaacatgcccgcgaggatgatcgtcatcaccatacattttaaaaacgtgttcaactttcttggcagttaagaatccatcgagcttagccgcgttattacgcaaaaagtccgctgtcgccgtacaaatgaatgttggcagataatttttctgaatgtagttttctgccataatctgttctcgttgttgacggatgatgctgggagtaaagtatgcagcaactgcacctgtcaccatgccttcgtctagcggaaatgccgccgcactattgagcacgactgcgcgaaatttcagattagttagctcgtaaccaaacttggaccgatattccggattagtcagaatcgttgcatactgctcggccatctcaccacctgcactgtcaccaatcaagaaaacattattactgtctaggttatattcggctgcatgttccgctacccaatgaatataacgatctacatcatccaattcacctggaaaagtcacatctggggccaaacgatagttagggttaacgaaggcaaatcctcgttgggcccaattcagaccataaaattgataagtttctttagtgccataacaccatccaccaccgtgaatattgataatcacaggcaatggtttaatgaccttagtaggccgatataaatccaacaaatgccacttggggtcaggaccataacttagattatctaatctctcgacaccagccacttcacgaggtaacccagcgtcacgcgcatcatcatttttcttaaatgcggttcgcaattcaattattgaccgactcaattcttttgatatcattgtaagcgcctccatttattggctctatcataaaaaaactactagccgattaatatagcaatatcaaccagttagtagcagaatctaaacctctttcagaacatcgtccataaacagttagtctaatgtatgttcagttttgtaaattgtcgctgcagtttgatgatacaccgcttgaaaagcatgatttagggcacgcgtacttggaaaaccgttcatcgtcgcaattgcggtcaaatttccacgctgacctagcagatcttcataggcatgttgggcacgcaccaaactaatatattctcctaccgtcatctccatatgttgcttaaaaaagcgcgtcaaatattccttggtcacattaatctgttgcgcgatgtctgataagctaattggctgtgtataatgttgatttacgtacatggtaattttttgaattcgctcaacaatctgaggtgctttcccataaatcacaccagaacttgccttagccgtcgtaaaatagatcaataagcgttggaggattgcagttgttagcgcctcaattcgtaggttcgtatacgcagttgactgttgtaacgcgagtgctagttgatataaatctccctgtaaatctaggtataccgccgactgctgctctgaaaaatacgctggttcgttaatcgcgattacttcatgctcaatggacggataaagtcgatgcacataatcgtacggatagattattgataacgcacaactatttgctgtattgatcgttcgaacgctatgaattagttgtgaattcacaactaatattgaccctgatttagtctgataatctcgaccattgattgtaaaatcgtcaatgtgaccactgagcgtatacgaaagttcgataccttgatgccagtgtggcgcaattcgctgtggcgccttagaatcgtgcaagtgaacccaagctgataagggctgtgtacgcgtgactatttcatgttgaaatcttgttgacaagtacgctacctccttagcgattagtgctggcacccattcatccgtttaacatgctattattcaaatacctagaacttgcaaaaataaacatctgaattgacaattattaaccagacacttaataacactatggtaaaataaaaaccgtgattatcgcaaggataaccacggcacgaaacgaattggcttgaatatacgtgctatatattacttcgtttcatacccattataacagataaaagttacgatggcttttcatagtggttacattcataaatttttaaaacccacgtttaccagaataaaacatctcaccagagtttagattacatagtagaaaggaagcatctcaacatggtaaaaattgcagtcctatctgacgttcacggtaacgctactgcactcgaagcagtcttagcagacgcccagaaacaacacgttgacgaatactggacagtaggcgacatgaccgttcgcgggccagaatcggagcgctgtctcaccttactagaccgcgttcaccccaccgcctacgttctcggaaatcacgaggaaaactaccaaaaagtaatggcagccaatcccaacacgtttactaaacccaaacaaattatggcaacggttctcaccgcttttgatcggcgccagctgagttcgacacactttgaacggttactgaacttaccaatgacagtcatcaaacacgtcggcccgttaaccatccgtctccaacacgttttaccgaccgtcgctagtggacacgcgctcgcaccaactgccagtcaggccaactttgaccaagccgctgaaggcgatgtcgatatcgtcatctacgcgcacacacaccagcccatcatgcgctacgcaaccacgggacagttgattctaaacgccgggacagttggtcttccgactgccattaatccccacctacgccaaccacgagcaaactacttgcttctgacaattgatgagactggcctccagcatgttgattaccgcgccgtagatttcgattggcagcgtgctatcacgattgcgcaaaatacccacttaccctacttcgaattctatgaacaaactttgcggactaatacttaccaatatgcaccgagtgcggtcgctgcttataatacgcaacatgacatggcccgagaagcgcgcaagattttacttgaaaatcgtcactgaaaatctcctaagaatcggtagaaaatagtttcatttttctaaaaattctgtatacttttaaaagtcgattactgcttcggcagtcaatcgctgttcaagagaggagctagaattatgtactttaaaaaagcgaccctcgatgatctcgatacgatcatcgacattctgagtgacggccgtaatcaacttgctgaagctggggtcaaccagtggcaaggcgactacccgtctcgcaaacaaatcacggccgacatcatgcaaggatcagcatacttattcaatgccgacgacaacgcaacggtcggcgctgtcgctgtcgtgccttcaccagacgaaacttacgatactgcgaaggccgaatggttaaataccacggcaccttacgtcgtgattcaccgagtcgcgattcattctagccatgcaggtcatggttatgccactcaattattcgaaaaaatcattgctcatattgctgcggatcatcctgaaatcaagagcatccgtatcgatactcatgccgacaatcaagcgatgcaacatctgattgcaaagatgaacttcaagcgagttggcgaaatggtcggtgtataccatgtcgatgacgtttgctacgtctatgaaaaaatgctctaattaatctgagaacctgaccacttgtggcaggttctttttttacgatcaaatccaatcagtcatgctaaatgactactcgtttgcggcagttgtcacagctaagtccttttgctcagcaaatacacaacgagtggctgtttgattcttataaccggcgcactagttgcagcccgattaagacaagcttggcttcatttttgtaacaaagtcgccagtgctgcataccgtttgcgccagtccaaaatagttagcgactcacagggttgcgttaatagccaatccaactgtgcttgccggtcaggctgatctaagaagacataactccgcggcgtaacaaagttttcaaactgacgacgtaactgtgccaacggaatgttaggtaaggttgtaaaagccgtaatcggtaacgccaatccggctttagcgccttcaaaataagccgcggtggttgtgggcgcgtcatgctgtaacaatgcgcccacaagcgctaattgttcaggcacgagttgcagaccctgatcacaacgcaaaaagagttgaattcccccattatcccccgttgtatagacaaatgcttgaaacggacgtgcaaaaaaacgccgacgatattccagaatcttggtgccatttataatcgcttgtgttggttctggatgcaacgaaaataataatgttggccgctttgacaagtaataatctttaatcgttggcatggtgccacccctccttcactaattagcactaagtataccccatttgcgagcgtgcgccaactaatcgtgattcgtgaaaacacgaactataaatagttaacaaacaatattattctgactttgtcctaaatttgctggatttaaaccctaatcagtcgtatattattcgtataaacaaaaaaggcggtattaatatgcattggttggcggatctattggcagcaatcggggtcgttttaaacgggatcccacaaggaattatggcgatgagtctcggttttgcggtctttccgactgcattttcattcggattagttggtttaatcaacggcgtggctagttcagttgcaccggtttcatttcaagcggaatccctcgcactagtcgggcacctgggacacgatttacgcgaacggtcgtcgattatctttttaggtgcgagtctgatgttcgtgattggcttgaccggtactctgccgctcatcgttcatagtctgggcaatcagcttatggcagcgatgatggcaggagttggcctgatgttggctaaaatcgcgttgcaaatggcgcacgaacaaccccaatttgggtggctgtcaatcggcttggcgggtgtgacttatttgatcagtaaagatttagtatggacaattgccgtttcagtgattggaaccagctgttacgcagcgacgacacattatcgcgtcgcactaccggaacatgtgacgacccgcaaattacaatttgtcaggccacagttcagttttaaaatcctgcgaggtgctctgagtctagcttgtcttaatatcggtgctaacctctcgtacggcttaattactggccaaatgacgggacaacaccccaacccggtcaatctaaatctactgactagtagtcaggcattagcagacctgggaactagccttctgggtggtgcgccagtagaaacgattatttccgcgacagccagcgcgcctgaaccagtaatcgcgggtatcctaatgatgttgatcatgatgctgattctattactgggatggctgccaaagctgggaaaagttgtgcctagcactgcaatcgccggttttttgtttatcttagggaccattgtcattttcccggaaaatgcaaccaccgctttgcacggctcgttaagtacggttgcaggcgtaacgctcgtcgtgaccgcccttgtcgatccattcgcggggctaatgaccggggcactcctaaaatttggtttaccattaattggattggggttataaatatgcaaacttatcagttaacattaggatcgctgacacggcagttaccattgattcgattaaatgccacgactagcatcgcctctttcgttctattgggtgacgctgagctgaccgactatgctgcccgtcagctcagtcaacggctaactaccactaaatttgattatttagtcacgatggaaagtaagggcattccgctagcccaggcactaagccaggccacaaaccaccctcgctttatcgttttacgtaagaatcgtaaggattacatgcagcacccgcttatcgaaccggtaaacgcaattacgaccagcaccccacaacagctagttttagatggtactgacgccgcactaatcaatcataagcgcgttatcattatcgacgacgtcattagcagtgggggctcgttgacagctgccaacgccctcctacaccaagctggcgcccaagtggtcaagcagatggcaattttagcagaaggcgccgccagcgaacgaacagatatcgattttttggcaccgttaccattatttgactagctgcggttcagaaacacattacaactcactagcgagtcacaaagcagaacaagcaccatggacttaaaccaactacttcagttatcaccgagtgcaacgagcaagttttagatggatggatggattcgttttaaagacctaccataatatgaaaagccctatgttagcatgatttatgctaatacagggcttttcgatgcttacgagactatttctacgttcatattcatgcaatgctaatattgtaaatttattctttgcaattggaaagttcacccaaaaatcattttgcctattttcgcatgattctaagaatacaaaaaagccgttatatcaacgatataacgacttcttaaaggtacttagagcttcctgaaaacctcttagtaccggcgatcggggtcgaaccgatactccctcaacgggaactggattttgagtccagcgcgtctgccaattccgccacgccggcaaaataataactagatggaacataaatctgatcaggattataaccttttcaggaaaggcggtaaccggatttgaaccggtgatgaaggttttgcagacctctgccttaccacttggctataccgccatcatttattgcccaaacccaactgggttagctggattcgaaccagcgcatgatggagtcaaagtccattgccttaccacttggctataacccaatcaaagggcggtaggtgggaatcgaacccacgcgtgccggagccacaatccggtgcgttaaccacttcgccactaccgccatcatggcagggatagtaggagttgaacccacaccgacggttttggagaccgttgttctaccattaaactatatccctataaagaatggaggggagtggattcgaaccaccgaacccgaaggagcggatttacagtccgccgcgtttagccagacttcgctacccctccataaatggcgcgggacggaatcgaaccgccgacacatggagcttcaatccattgctctaccgactgagctaccgagccatatcattcttcatgatggagtctattaaattattgatgagtaactctcatcagatggaggatacagggctcgaacctgtgaccctctgcttgtaaggcagacgctctcccaactgagctaatcctccataatgacccctacgggattcgaacccatgttactgccgtgaaagggcagtgtcttaaaccacttgaccaaggggtcatatttattatatctaactaacggagagtaagggattcgaacccttgaaacaggtataacccgtttacagcatttccaatgctgctccttcagccactcggacaactctccatggcttaccgtagatatatcgtatcagcccgatttaataacgtcttgaccacctgaaactacttttgcttgtccgcaataatttcgaattgataggtggttggaaatattggtaagttggctaaagcccaattgcgatacttcacatcatatttttctggcgggacgagttcgaccaaatgacccagcgcgtgtgtcaccagcgtatcattgggtaacactggatcactaacctcatagtaacccgcctttttctgactcttttggaagaccgtcacatatgcccgggcctggctgggtttttttgctaaaattaccgttgccataatttgcactcctaacattaatttagtacagcttaccagcttggcgaccgtagcattaaaccaactcctaaagtcccacaaggaagaccattgcattacatttaaaattgtactaaagtaaccactgtacgattatttctccaaaataatccagtataccttttcgtaaaaagattagttctatgtgctatatcttctactccaaccactcataacccccattatgagtggctttttgttcttaggactaccttttagccactgaaatatttattgcgagtaaccggttgcatattgcttgccattttttccactttacggtattttaaagctatcaaaacgtctcctgttctggtgttatggtatatgacttaatcaattttcatcacatagttccctcggaccgttcgcaatcctcattacgagcggtcggttattttttgtgttacaataagtcatagaaaaaggaaaccttgcttgcacaaggcttcctatgtagagccgtttaagacggtagcatttactgcgttaaataaccgctagcttgccagagctaaggcggttattttttttgctgacttttaatcagctcaacaattaatgcgattaaggctacgataaaggtaccgaaatccagcattaattgtaaagcgtccgacacggacacttgggctactcctttcctggaatttgggttggcttattaggtttacaccataagcaccacctccaatattggaaatagccaccgccttaacttctctactagcatagtataacataatgcacgctgtaactaccgatactacggtattcacagcgtgcattttagctaatttatccattgtttaattgcttgttcataatgtctatctggctttactcgtggtctacgggacggctaggatttaaataacaccctagtctagcccagccctaagtaaccatcgctcgcgttcccattgcttcaaaacctaacccaaccgtgctataatataggcatagaaaaggaagtcctgctagtacagggcttcccgatatagagccgtttaagacggtgactcgcattttattaaataaccgctagctcgtcacagctaaggcggttattttttttgctgacttttaatcagctcaacaattaatgcaattaaggctacgataaacgtaccgaaagccagcattaattgtaaagcgtccgacacggacacttgggctactcctttcctggaatttgggttggcttattaggtttacaccataagcaccacctccaatactggaaataaccaccgccttaacttctctactagcatagtataacataatgtacgctgtaactaccgatactacggtattcacagtgtgaattttagcttatccattgtctaatcgcttgctcatactgtctatctggctttctttgtggtctacgggacagctaggatttaaataacaccctagtctagcccaaccccaccctggaactaaatcaaactcaacccattatataaactatgcaccacccaattaaggcgcaagtcgtgttgccgctggtataagcaagccaagatcaagccagccccaaaatacaatagccaacttagactgagccgcatttcatggacgctcgcaaaagcgccggcactcactagagcctgccatctttgatgttgtcccaaaaaccagcgacaaaataagcctcgaaacaataattcttctagcatgggcacaataataatcaagtgtccaaacaatatctggcgccacccgcgcaaactagtcacccagtcggttatatttttctgattagccgtagtcgcttgtccgataccatgcataattaccaccatgataaggctaatcaccaccaaaccacccaaaaccattccgccctgacataaaacttgtctccaatgatcaaccgattgccaccaagcctgacgacaaatataaccaacccctactaccagtcctactaacactatcaatccagaaccaagtagaaacatcatggcactctcagacttagcttgcagtcctgttaagcacaccccagtggcccattgttcaattagaattaatcccaaccagccccctactttgaccactaactgcatctcaccgcccccgttcttgttgggcttgttcaattgcttgttgctggttaaacaacgcatttttgacctttaaatcttgataatgggtctgttcggctcgccgcaattgctgtttcacttgttgcccttcttgctttaagatttggtgactggcctgttgctggttgcattgaaattgctttaaatgtcgcggcttccagtggttggcagtcgccttcattggctcccaaccggccttgccggcgcttttttattccgcttgattttatcgttgaaccgttcaattttttgataccgctgttgcactacggccggcggtaaagcttccttatagctagccagcgtggctttcaaccgcaacaattcctgttgttgtttagtgatggcttgaagttgggcgcgcatctggcttggcttggttaatttaacgcctagttcctcacttaacgcttgctggagttctggtcggagctttgaccacgttaccccactgaccacgctacccccgttaaactcactttctgccgccaagcgtgcttgcattttagcgacctgtggtgctgttaatttatcaatcggtacattgacaacatcagtaaaatacgctgttaaatcttgtaactgttgccgttctataggcatttgttcccatggagcttgtaacttcaatttagcgagcgctaatcgttgttgataccggccacttaaaaaggtacgagcctcacgttcggccgcattgagtggcgtggattcttggctcagtttcgttaacactcgctgggcttgttgcaccttggcctgactggctcgagcattttgctgacgcaaggccatgcgccgttgccgcaattccttagtttttccctgtgttggctgtgaccgatttgcttgccgtaaagcatcgatccgttgacagttggtttcaatatcggccgtggtaaagtttttggctagtccggcaatggttagttcagtttcattgtctggtagctcgcgacaagctttgaagagcgcattggtgagtcgttctcgcagttcggcttctttatgtgccagcgtccgcccagccgtccgttggccaaaggcggctgcattgtactgatctagggcctgcaccgtttgctgaaaggcttggaactcgggattgccatgcaaatattgattgaccaggtcactcgctagctgtttgggtttcgccatatcacgagcattacttcgagaccaccatcgttttttatcggctggcagactggccaagagggcctgcagctgttgttcaccaacggtctgactcagttgttggtgcagactagctcgttgaacccctaaccgcttttccaaattcaatttgcgtgttttagcctgcggtcgttccaaagcaattaagtcctgaaaaatatgacttttgatgctccgaatggacggttgagtgaatttccgccgcgcttctttcgtaacgcttttaccgttccgataaccaattttatctggtcgtgggcttaactccgaaatacctagatgcacatgaatatgggccgtattaaattgaatatccccccaccaaaaccccttttcggctaacccattagcctttaagagcggccccatactgtgacgcaccgccgctttgattttctgttgatcacaggcttcggtcttagggtcatacaagtgattatcaatcaaatattgcgttgaaaacgagatgaccccggcccataagacgcctttattcgcctgggcggtatctaatttttgccgtaattgtgccgtctcagccaccgttaagtgatccgttcgttggtcaaaggtgggcgttaattgttgctgattgggcttggcaacctcgtcaccttgatctaactctgtcgccgtatagtcgataaatttttgataaggcaagcgcgttgccactccctctaccgcctcaactggttccccatcagggcgctgactagtcggcgctaattccgctaggttggctgtttccaactgatctaaccgctgttgtaccaaattaacatcgttacttaaatccgttgggttatcacgttctgtgtatttcgtatacccactgtagctcattttattggccaccgtcgcggcggtaaaatattgcaaactaaagacgactgctggttgctggtgctcaattggtttcgacataatgctgtgcataccagtccttccattgtctaaattcagttcgattaatctttaaataactggcattcacttttaataacgcacaaatttctttctcagtaaactcaaagtaagccagtcgtgcggcctgttttaaaatgggtacgcgctcggttgcgaggacttgatcattagcggcaaattcggtaaacggcaccggtcgaatcttaactaaaatctgatacagctcacgttcccgagcaattcgcggccagtcttctgcaccaacttgttgtcgatacgtggcatcgtcaacgacaaacttttctgcatcattatcataggcgccaatttctatggcccacttatggtcagccgtatcaaagctcgataattgcgctaacacatttagaaactcgtcggacaaatgccaattttttttgctagcggtcttgaatttatcaactaacatgcccgtccctcccacttttagtgttaccgtaattgattggcttgaatatcagtttcaatcatcttttgcacttgttgcatcgccatattattatccgaaccgggcgtataaattgacccaccctccgtcacaactccggccgtacgattataaatcgacaataacagatacttgatttcggcttcattttgccgatttaaccgcaactgcttaccaattttctggttcattggtgactcctgaacgtgtttcaatagttcagcttcgcgcccataaaatgatttttgccctaaattcgtgtaaagaaacagttgaataaattcgctgatgatgaagttatacattttattttctgtacgcacgagccgagccaaatcaggatcactttcaaagtaagctttaagttcggcaacccgtttttgattataagtatccaaccgtaaattgattttgcgacctcgttgcttgctactatcggcaatctggtcattgtaatctagtggattttcgttagccatttcaataatctcccttcaccatggtcgtcaataaattcttaatctcggtcaattcattggtattcaaattagtaacttccacgactcgattcatcagggccgtttgttcaattaaatggttcgtaatattcccatcaatgaggaaatccaaattatcctgcgccaccacttcattaataatggtgcgcataaaatcagaaagattatcataacccgctaacttacccaatcgttttaatttatctttatcagcttgcgaaacattagtcactttaatgacagttttatccattataagaacctcccatagttccaaaaatctaacgttaaaaattccaaaccataccggccaacacaacgaaatctaagatttctgcttttagcggtttagagtgccaagacgaaatttttaatttctgtggtactagctaaagagcataaggagaactagaccctgccgattaaaaatcgccagggtcccccgcagtgcgggggtttctatagggacctgcgtttgctcgttttttgacgttttggccaccaaatagccaccgcttgaccgccttttgaccaccagataaccaccgtttgcccacttttaaaaatttagtttttgtgcgttatttgggtacttttagtgaccttagcgagcttaaaagtgccattttttatcgcggcttgtttctttttaagtaaggcttgttccgcttttaacgtgctaatacggtgcttcgcaccattatattttgttggttttgttcgatgtcgccaattaaagtttcaatatcattgtccgtttgggtctgttgactagcgacttcatacttacgattcgttcgcttcgtttggatcttatcgtggtccgcgctaatggccgtcttggccagtttgattttattttgttgccgtttaatgctggtgtttcgcgctgaaatttcatcattaatggtctgactggcaaaggcttttggcgataaagatgaaacctgggcctgtctaatttttgcctgattagtcacaataaagtcagcttgtggccttgatgaactcgtttgatctgtcttaggcgtggcattaatcaaccggaaccgaatcgcttcaaagttctgctttaaatgatcaaccatcacgacatacttgttttcggtgactggaatcacgaccatttttagtttttgtggcaccactgtcgctaactcaaaatgtaaatattgcgacagaatttccgtggtggggtccgttgacggctgcacttcaaacgtcgcaatcaggcgttgttgggtcggactatattgccgttggactagtttgacgccttgtgcgctgttatcaccactaaagctctgataactgtttaacggggtatcgtcattcttagccgtttggcgatttaacagcccataattaataattaacccaccggttaagaccaggtaaagtccgataataaaaaaaccggcgtagccggctatgttcttttaaataccgccacccggtagttagttttttcatcattcaatctcctttgcagggttaattttcagtcaataagtgtttaattttggttaagttcgttccttgataccgagtgacttgaccgtgatcgtagtggattaaagtgggcgtttgggtgactttaaattgcgttaagtaccgtcggttttcagccttttgggtattaatattgacaatctgtagcgtctgactgaaatagtttttgaactcacttcgtaacacttgcggcgctatttggcgacaatcacgacaccccggttggtaaaataacaacaccgccggggtctttttcgataaccgttgccgcacaacttgcgtggccgtcgtcgtttgactgggccgaattaaacgctcgggttgccaatagaaccagctcactatcccgaccatcacgaggactaaactaactgataaacctttcaaccaccagtgcttgttagtcatacctttcccgccattaattgttccagtttaaattgggcgactaatttttttgacggtttaacgggccattcaatacggccaacgaccattgttgggctaagcctcgcgtggcaaatacttttccttgaactaaatcccccgcggttgtatctaaaatgccgtattgactcatcttataacgtcccccgtttcactaattggcagtgcttagctaaggtccaatcattgtggcctttcgcattatgcacaatatttacagtcgtgccattttccaaatgttgttcgattaactgacccacttgcggcgcgactggcactttagtttccccgttattggctcgcggcttgtaagtcacccaatcccctaaatggatcgttttggtcatcattgttcttcactccaaggattttgttccagtccggcttccaagcgttgcacgttatgtgccatcttatcttttagccgtaataaggctagaatcgcattgtcataggcatcaatcttggtaaaatcactacgttcaaccacttcatttaaccgatcagccgcgtcaatcgcggcctgaaccagttgattaaattgccgatttaactcgttgttggccattaacaatgtttgttggtgcttcaattgttcgattttctcagtcatctgttcatatttttcactggtttccgcgtattgatcgcgttcttctctgagcgcttcaacctcgcgatcaccttcggcattaacttcttccaaaagttggttcttagtggctaacagcttagtttgcttctttagatcttcataatcctcaggcactgtcggtactggaatttccacttcacgaatcccttcagccttaatccgctgtaatcgagcttcatacttatcctttaaagctgcttgtaccgcttcatgttcatcatctttagcttttagttgtttttttagttcacgcaattcatgaaccgtcatttcatcaggggtcttttcctcacctgactccaagcgatgcaacttttggcgttcttcttcgggcaaagtggcaatttgatatagggcttccactcccaaatgttgcgacgtcgcaacatttgattctcctaatccatcaactattttcactgctctatttgcaaaagtcttgtcaatacctactgatttcaaccatttctcatactcaccatgcgctaagtcattttctttaacccacttcaatcggcgaccaatttcaaagattgactggcctgcaattgactgataactcttaatctccgtcgtaatttgggttaaatccgttgataaagcttggtcactaggtgtctccaccacttgttgggtaatatcttttcgctccatttactggccctccttattttttaaagctcatgtgaaggcaacaaaaaagggaacaactgttttcccagttgttcccttatgtatctacttgaccaacagtcggcttcagttaacatgcgatcaacaaattatctaaagaaaatcggccttaagaaccaattttctgctgattttatgctaaacttaattccgttactgctgaaacttagtagtaacataggagagcaagtaggaaacataggatcttatgtttcttacgtcgaatcatgctaaagcttggattaccagtccaatttcagtgattccgaagctctcttttttgtggcctgagcataaactagaattcaaactttcccgttgaattaaggttgcaagctagacaacccgtaatcaagaacatacgttcttgattacgggtttaatttatcacttctttaccggaacgtcaatactaatactcatttgtcaatattcttaactttgatacctgcttcatttggaaaatcaaagggagccatcttatactttgagaaaacacgctgtactaaaagtgccttaacagtcttggaagtaccagcgatatgttctgaaatcgtgtaacctatgaatttgtgattattaactaggccggggtgaattggctttatcaaatcataacttgcagtcccaccatcatactgtttactagtaaatttcacactttcctttacaattttctttgtgtttttatctttataaacagtaaaaatactctttactggatcaacttttaaatctttgcggatatttcgtttgaattttttctttataatattccaaaactgctatttatactattaacacgtgatactagttaaattaagaaggttaaaaatcttgacggcttacactacctaaatcaaagaagtataaacatggcagaccaacttttatattgtttattgagcatattcagttaaaaagttgtatttcctctatccctattccaaatagcgttgtcttttaaaatatgtatagaaataaaaatgtttttaaggcatatttaagttcttcaaaaatatgcttagggggcagatttttgaagaacttaaataagctgggcttcaaaaaaatttctattcttatcctagcagcagttaccattattggctttttggggtaccttttaactagcaataataaaacgttatttattaaagtaccagcaaatatagaagcataaaaaatggtaaggttactataataggaaagacactatcagatacgactgttaaaattggatatggtatagttggtgataaacagaagtctgataaaaatggtaatttcaagctgatgtatgacttaactactaacagtagagaaactttaagaatcacagctgaaactgattcagataagaaaattgctaataccattgtctctctccccaagaataatgcaaatcccccaaaaaagataacatctaaaactaataaaaagaatacaagaatagagaaaatggcaaagaaatacacgactgcgtatatttttaagctcaaagattatgatatcatttatttaattaatgagcacacaaagagattaacctatactacttcaaatgatcatagtatttcaacttcaacatatagtgggaattttaataatggaatagaatttaatatggatagattagctatgcgggcacattataaatatctaaatcaagcccctactttaattatttctgataaaaatggaattgaaaacaagacctaccaaagaaaacctcaactggtcatacagtattatgaattaagtaagtaacgcgtgatgctagttaatttttaaccaagtatcagtatcaatattctagacgtgcttgaaagtccatatatcatcgtgcaggaggctctatattaaataaacaacataattgtgaaaacaccgtctctatccaacgctattgctgctttaataagctccccatcactttaatattgtttcatttttttatgatatgatatcccaagccagatgccttttcattttaaaccaacctgaatgctagcaaatactcttaatttgcgatctttctgatagtgacaaacctagactagataacaagcgataaaatgaacgcttattttatagtccaataataacttgccaacatatcaaagctataactgtgacatcttgtaggatagctttgtaacacattcgttcgatgacggataaccgttggaatgtacttatggcacagcggactcagggattttttgccattcgaagcatggatcttgtattcgattattactttgatcaaactgaatttgatctgacggctaacacttctttattttaagtgttagccgtcaggatttttttatcttctaaatttaactaataccacattgtacgttgtttttcttgtgtgcttccgaaacaatatttttccggatctaaaatctaagtgcaacacctaaaaaactagaccaaaaaggtcatgaagacctattcttaaatcaccacaagataagaaagagctgccttcatgacccataaccagaataccattactcatcactaccaacaacttcaatcttacgaacgcggcctaattatgccgtcggattgcccgtgaacttcaccgtaaccctagtaccatcagtcgtgaactgaaacgcgggcctattcgtcaaagtaggccccaaccacaagccgtttgaggcctactttgcggatactgcccaagtggtctatgaccggcggcgtgcggcgtgtcacttagttagttggttgttaaaagctcctgagtttttccgccagctagtgatagaactgcgcccaaaaaaacacggatccacagtgtggattctttcgttcactggttcaaacttaaccacgctgaaacctgtcgtcaagcgcttcaagacatcattgacgactacggtccagaacacttcaaagccgtgatctttgacaacggctcggagtttgcgaacttgtcccaagtgactggtacgacgatctatttcgcccacccatactaaccgtgggaacgaggatccaatgaaccagttgattcgcaagttcgttcccaaaggacggtcggtgcggcccttgaccatcaccggaattcaagctattcaagatgctttgaatcaacgaccacggcgaattctcggctttcaatcagctaaggatgtcctgccagactttgattaactagaccgctatttaagaatagtttgtaagtgttgcacttgatctgacaattcagggaaacaatattttagcttttctcctttattctacttatatatgatatagccctaacaaaatccagccattcaccgtgccaataattttctgcaccgccaatatgtccgtatgcgacacattgtgccagcctaaataaaaattcatcacatcacttttatttgtaccattgcttccttgaaatatcttatcaataattccattattgtttaacaaatcagatggaactccactagcaagcacaacaagccacttaaatagatctatcataccttaacccctctcactttcaatttacagcaagcttaatcactgccaatcaaaagcgagaactcctgctcatagcgtctgtccgaactttcccggcttaaagcccgcctcggccaagacgctccaatccaaatttgaatgtctgtcgttaataactaactccaaacggtttggaggctacgggacaactaatagctgaaaaacaccctagtctagcaccaatcttaatccccataactttgacacacccaacgaaaatccacttgtccagaactataaatacgtaatggcattttagaacacaaaattttagcccgtatccaccaatctcagctgttcaactttagtcgtttctggagcactggttaagctgaatcgtcgtaacgccagtaattgttcagttgggcccaagaagcgcgctaccattagccaatagtttaaccgttgggcttgtttgagtgccatcgcatgttgcaataggctactccgggtcgcaaacatggttgcttgacgaccatgtcctttttcacgataaactaagccctggtcaatcaatttattcagggctttggttagactacctaagcaaatatttaattctttagaaatgtgacgtaaagatgttttggtaaaccaattattgtcctgggaaattctttggttaaagtaagccatgagatcagcttgccattcatgaacgtgactattaacgcgttctgtgcgcggcttcgcatacttataccaggtcgtttgtgaacgctgcaaataaacccgcctgtcagcatcaggaacccaagtttctagcaacgcattcacatattcacggctggccgcatggaactggcctgaataagcgtcacgaatcactttttgaacgtgctgtgtcgccagcgggtggctaagattgctgttaaattcgtccaaaatatcaaaacactgggcttgcgagacatttgaggaatagcaagctaaggccagcgtgaagattgtattgtgccgaccatagcccacgttttgatcaatgtccgtttggttaattaaggcttgaaaccacggttggtcaatctggcgactagtccgccgagccataaaagaccgttgaatagttttgggcttaatttggtgctggtcattcgcaaagttaatactccaagtcattaaagcttggaagtcaaccgtcattttaggttcaaagtactcaatattgtctggccgcgggactctgaaaacgccaaagctgttgcaagtcacatcgaccgctggtaatttttgcgcgtagtattgctttaacgacttagcaatcgctttagcagccctgacggctggcaattttccattagcatgacgacggacgaacactggctcatcaaagacatagtaaatatgatagcccttctgggtcgccaaaattaacgttggcataaactggacgtccaacatcgccgtgtcccaaacctcggcaaacttcgcttgccgttcctcaacatcacggtagtcaacgtcaaccactaacgtattgatctgacttaaattttgctctttagcccctttaacataatgcttagccgcatcagtataggtgagatagttaaaaacattgggcgtccaatgcgtgctggtcgcatagttatcatagactgcttctttggaggtataaatcgtcccccagcttttcgccatttgggctttacttcgatacatggcaatcgcaccttgcttattttgctgccccggaaccgatttttctaacttcaagacgttactattctgggctttagtttcccgtaatccttgatgcaaaatcaaatcaatcgcttgttgtgctgttttcatcgctgacatactgctcaccccctactaaaaaagaacgccgtagcgttcttagtcatcatttttatgtattagaattaaccgttcaaacactagatttttaagcaatcgctccagttaacgtggctacttggtatttaaaccccaacttggctcttagggcggtcaaattcatcaaactgtacccttgccaaacgtaactggcacgagtaaaattaactcaatcgtaatggttacagagttcccgtggcttagaccccacggggattttttgtttatttaatttttaattggcattagcttaacaggtttcaacaaacacgaagcacttctccctttaggtttaatcaaacaaaaagcagattaagccgcccactgggtaacttaatctgctttaactaaacctatgtatgcgtttgactcgacttttcgactggcataatcctaataggtttagtataatattcctatcaggcaactagagttgactacttttagtagttcatatcctagctagccatctataaagacgagcgttaaaggcgatcaagcaatacggtgcttggtttgctgactaaggaattattcaaagtaatttcttagtcaacgctcttttcttataccataaattatattgattttatcattgcaagtcaaatttccatgtatacggtgtacagtgttctatatacaatatacggaacactgtacatggaacactgtgtattgtatactgtacacgaataacggaatgcattaggaaccgttaaataagtattttatcttttctgatttatcatatacacaatacacaaaatactgtatactgtgtatatgatactgtttactgtatacagtaaacgagtgaaaggagttttaaaaaatgattattagttgtgctaatgaaaagggtggcacgggtaaaacatccactacagctatgttaagctgggaacttgctagtctgggatataaggtacttatgattgattgtgatccacaagcaaaccttactgacttgatgttaaagaccaaaagtcatgaaaacactgtcgtaactgttgatccttcattattcgctcttttaataaataaacgaccattaacagatggaattattcagataaaaaataatttaagcctcattccggcagctgccgacatgaatatgttaagtcgctggttagataaacaagaattgaatgaaatagaaaaggttaactatctaaaaaatgcaatagaaccaataaaggatcaatttgattacattttcttagacgtcagtccaaccatgagtttgaccaatgataatgtatttttagcatgtgattggctaattattatgcttcaaacccaacagcgtgctttactaggagcgaaaagctttttagattatcttcaaacaaatttgataaatgaattcaacgctagtgttgacgtgctcggaattcttccagtattaacaaagggacaatccattattgacaatgcaattttaaacaatgcagtagacgaatttggacggtctaatatttttgataatgtaataactgctatggagcgagtaaaacgttatgacatgactggtattactgaaagtaatagatctgtctgggataaagcaactcatagcgcctacaatgccgttgcccaggaactcgttcatagattggaggacactaaatgagtaacttgttaaatcatggtggaaatcctgataagaaacgcggaaatcctgataaaagagtagaggtcagtgctgctaccgtctcacgatcagcggcgggatttggtcaagatactgcaaatgtaattccaacttttgacgtgaatatgagattagataatcatgctagaaatgctattctgtcgttagctaaaactaccgccgataagcgcaccgcttctgaaatggtcactattttaattgaaaattacgtttcatctttaaatcctaaaacactggatacgtatgaggaattacttgacatgttggaaacaaaggacagtttgaattacaaactgaaaaaacattagatagtgtaccgtacacagtattaaatatacggtacactgttatattataagaaatagagtagggagagaaggcctattactgtgccccttttcctactctattttttaactcagcattgatctttaaagttatatctgctttcttaaaacgataatcagatagagcttatgcttatcattttccagctacctagtcacaactaattcttagaattcccctgagaagcatgtcgggaataattactttgaatttgtttctagcttgaagttgttttaaagttttgggttattaagatttatctgccatttttaaagaccatcctttaaatgacttaagacgtccctcgatcagtcttcgttcccagtcccaaaccatcatcggttgcttcaatctgaaatgggtcgccgttactggatatgaggcatgatattattgtcgccatttgataaccttgattttaaaggaatagtcataaaatgtcttcctacgacaatgctctaatccttgaatgcccaaaatttcaaattgagtgagccactgataaatcgtcgcacttcctttgatatcatactttttcacaagtaacaggggcgaagtttcctggagatacttacttaaaacattctaagctttatagtgaatcgattatccgacgggatagttgattcactattttagttttgttctaaactttaaatagtggtgaaactatatgccgtaagaagtttagacgcttgacgtcgtccttaaaacaggcagttttacttagtaattagtattctcttcgaagaatgtcgacacttgatgtccagtttagaaaattaaaaataattaccttagtaaatacgttccaaccactaacagctatttaggagggtttaaaatgagcattgtctttggcatagatgtaagtagtcgtgatttcagtgtttgtgtacttcagagtggcgccacacaagaatataagatcactaacgatactatcggctttaaaactctgttgatagatctaaaagaatacgccgaacatccacaaatcatcttagaagcaactggagtttattcacgcagaatttctagatttctagatgaatacgattatgattatgttcttcttaatcctttaaaggctaagaaaaaaattaatcagggcttacgtcgcaataaaaccgatcgcaatgatgcttaccatttggcactagctcaagattgaaatcagcatcaacctaatcgaaaagagcctgaggtttatcatcaattgcagtctttaagtcaggcttatgaggaattaactcacgatattatttcttccaagaatcgacttcataaatatttacaattaacttttccagaattagaaaccattttcaataactctagaggtgttaattactggtatttagttgagctctttccgcactgccaagatgttagaaatcttgaagtatcaaccatcgctaagcaaattaaagattttaaaggttatggtattaaccgtgctcaaaaactagctattaaacttaagcatctcgcggatttagcttatccagcagttgatcaagacgacccggagcgtgatgaagtggtttattacgccaatagattattacggcttacagctgattgcgagcggagatcagaggaaatgattaaattagctaagactttgcctaatcgcgatctagaaatcttaatgagcattcctggtatcgctgaaataactgctgcccgaattctagccgaattaggcgacattagaagattcagtaatccaaacaagataaatgcttttgttggtattgatccaggtagatatcaatcaggggaaaaaagattctttatcgttcaattggacaaatcgatctagcggctaagactagtccatgtcatatagcagattactatgaacaaaaaaagcaattttctcaaacgaaggggttcaagaaaattgccattgcttcaatccataaactgcttagaacggtctatattttgattatcactgatcaaatgtatgattacaacgtagccaacaataatcaaaaagacttttgtcgcaattaattgatcaggttcattatagcctaagttaacttcaaagaagtaatttctttgaagccttttgtgatgctcctaatttagaaataaaacgcctcaattaaagcaataatgccaaatatgtcataagttaaaactttagagtcctaatatacttgactttacgtagaaaacttgttgctttattttagctgaaaacatagtaaccccccctgagtctggatttactccaactcagggggttcactttatacctcaattggatggatctttttattgtcccccagtcattataaaactgttaaatgattgaacggttactaggtaacgtgactaaacacatcgaagtaggcatacttaacaatgactaagactagtaaaacttgttaggagtgtttgcaactaccatagtcagtttttattatagcacaattttgagttagtttacataacgtcaatattaaagactaaactttgtgaattctagttaggcctattatataagccttttgagataacttgttgttaaggattagctcagttaatctaacttgtgcaatttgcttaagctgacctaatcagacgacttatgattttcctggtcctttattttttatcaaaattgtcaataatgtcttttctagatctaataaatggtataacttcatacgtacgtatattattatttttattcataactattttccccattcagtaggttcatttactgaattttgggtttgaatttttgcagcttagagctggttgagcagaagtgaataacacactagatgttttaacaagcgaggaacgtgctgaatatcgaacggtgaagaatatatatactagcagacactcaaaacaatctagtattaaaaataatttagatgaaattgttgtactatataaatagaagataaggaggaattaaaatgtttttttcagaagcaatggctaggcactatcatgagaatgaagataaagaagaagcacaaagattagccgataaaaagtttgaagactttattcaaggaattgacgaacccgatagtgaagagcctaataaggactgactagataatgttgccagtgcaatggtcactacaagggatgataaagaaaagagataatgcaagatgtttagaaatttagttaaactatcccaataagaaaaggcccagtacttgaaaactgaactttcatcgcttgccgtttcaagaaagatcggccttcaaccacaacttatataaagagagctctcatctactcgtacaaaggtttagaagagctctctttatatacttttaagcgactatttcacgtaaagttagtcagaataaccgataactatggatcttattacaaactgatatccagacacttatcattaatcgtatcgtccattgtaaatgtttctcagaacaaatttaaagtgtgaacacagtgcttgtaaaatcagttatactaatatttatcgtggtaccgctttgaataaccttggtgagaaatgtaagagtcatgatgcccgaggcttggcctaccgattaagacaaatgcgtaaagtcaaaggaactatcagagaatggcatggtcattttaacgatgtgccctcaatccatgaatgcctgctttcagctgaaaatagaagtcgttttggtaattgtgaaggtgatactgtacatggtaacccgtccattcaacgctggtaacactagtcgaccgtaaatcacaatatgtattagcagaagggggaagcaaattcgcagctaaacctatcacacaagccatgacagacttaacgccgaaacgtttcaggacgcttacacccgattgtaagactgagtttgccaattataaaaacaccattaacaccttagaaataacgttgttttccagaattattgctaatattttgattattgaaattttagccctattggcatgggtcatttatgatttatatcgcggcaacaaacgatatgccgctaagctggccgcgcatcaaactgagagtgaggctaaataatgagtataacttttaaaagaatcttagtaggtgttgatgattctgctgatgccaaattagcttttaagcatgccattaacgaagcaattcaatatgaaacagaaacggtgttgatggataaaatccaccaacaccaaatatcatagacttctctaagttgtaacctatttggagcaaacaagaattgaaactttttgtcatctaaaactgccgcaggtggtcattgccaattacttaaaccggacaccaacaataatttcatacgaattagcacgctgtcagccttatcgggctaatctgctcaaaacaaggcttaacgtaggcgaacacattgtgattgcaaaactaattgaccagtaatttaaaacaagtaattggcaatcatttacgcttaagctagtcgctggaggcctcaaattagcaactaaatcaacctataattggcttaaccatggctggattcactttctattaagtgaattgtttgaatgcagcttacaccatcaacatgaataagacgtatgattaaaggcaattacgcaacgtaggcgcatctgtgaaaattgatatggttgttggaccacattggtatagtaaagcggttttgttgacgttactcaatcgtaagttacgattctttttggctcatttattaaaagatcggtccgtttgcactaggccgtttctttgtgctgagcgattgtggtggttgaaatagtcgatcccagcttcaactagccgaactagttcttcgtacgtctttgccactggatggctcgccatccagcgcaatttgaattcattccaccaacgttccattggcgcattatcatacggtgtgccagggcgcgacatactgcgtgtaatttcaaactggctgaagtaacgattgaaggctcctgatgtataagccgaaccgcggtccgtgtgaatcatcggatgaacattgccagcgcctgcgaatgcccgctgaaagacttgaatctcggcggcactggtttccgtgatactaaggttatacgacaagatgcggcggccatagaaatccatgacgccgcttaaacggatcttgtactcaccattcacaccataacttaactcagtagagtcggataaccacacctggtttggtgcgtccacgtcgaaattctgactaagtaggttgtccaggacatactagtcttgctgcttaattcgactacgctttttcagccggacttgacaacgcaaacccagttcacgcatcacccgacgaaccattttaagcgtaacggggaaggcgatttggtcatcgtgttcgaggttaatcaatagatttccagccccgatgccacgacgatgaaaatcaaaccagtgctgcgtgcgctctttaagcacgcggtcatgactttcccattcggtctcttgacgcttcaaacctttataatatgcttgcctgctgacaccgataattgtgagtagctttgatacggcaccgcggttaccttgactgactactttgattgcgttgtaagccagtcggcgttgtttggtcaccccctgcgctgaagttcctgcaatttttttgcgaatgcttccactaattccttgtcggccagttgtgatttgagttgacggttctcaagtctgagtttatccacttcggtcaactcggccgctggtttgcgatggccgcgcttatctaccaacgcctcataaccgcgctcttgagccttgatgacccacgaacgggcctgttggtaagaaacctggaagtactcggcggcttcagtgtaactgtgtttgtgttttgtaacgtattcaacgatttcgatgcgctcttcaaaggtcgtcttacgactcatagtgggaacctgctttctggacggcgaggccgtcaaggtatcactattgaccccatgtgcccgagcgaaggtgccaacagacacgtgtgatcgccgaagtgcatctaatattgccagcttctcagctgcattgtgtttagatctgggcatacaaaaatccctccatgattatcagatgaattatgatatttcatctaacaaccacaaagggattatcgcaatatcagccataaacgaagcattgtctaaattaactttcatctttaaagggccaacctcaaagcttaacggtgatttgtggtactgaattcagtgggcttgatgtttttgagactcagttatggtattagaaattactattgccatgcctatagttcggttgaacgtggcagcaatgaacgctttaaccgaattttgcgttattgttaacctaaaggaatctattttgagcatgtaagtgctcaataactacaattatttctggaaattaatcaacgaccttcaaagttttaaattgccaaacaccgtatcaagttttgatgattaacttggtaaataattcggattacatttgcaatctaacttaatttttattaattgccataccatgtctagttaaaaatagattgatacaaaaagactgctagtattgccccaaaaatcggtgctaccacaggtacccaactatactgccattgtgaactacctttatgttcaaaattacaaatagcatgtaacattcgtgggcctaaatctcttgctggatttaaagcaggacccgttggaccaccgaaagatactaccaaacacattactaaaaatccaaggccaatgaagtctgctcgtgaatctatcttgtcagcagtaatacatagtgctcctaaaaccaataaaaaagttccaataagttcatttacaaaaccattaaatctgctgtgaacagcatctatggttgaaaaagtacctaagatagcctccgcattagttgtttcatcataatatggtttatacgctaatactattaataactgacctaaaatagcacctagtaattgagcgccaacatacggtaatacttctcgccacggaaactgaccaccaatagctaatgcaattgtcattgctggattaatttgggctcctgaaaccgtagcaaacatcaaagcaggaatcataacgccaataccatatccaaagcctatcaatacccagccaccgtgaaaacctttagtacctttgagttcaacgtttgctacagatccatttcctaaagctaccattactgctgtaccaataagctctgctaaacaacgaattaataacgaataatgcatctaaatattaccccaccattgccttatttttatcttcatctgacagttcttgattcatgtgaccactatagaaccctgccaagtccattgccacatactgataccccaatttttgcaagttactcgtaatatcttcacccaaatcaatcaattttactaattgttctttcttaacctcaatacgtgcaaggttttcatgaactcgaaccctaacggttaagaatcccagacctctcaaatacttttcagcattcataacacgttgtagactttcaacacttaattctgtatagtacggaaaccgagatgatacagaacaagatgctatcttgttccagtttgaaagtccacgcatttgagctaatttgcgtacatcctttttataaatgtttgctttctgtaatactgacaccgcaccaaactcatctctagcacgtaaccctgggcggaagtccaaaatgtcatccataatcattccatctagaacaatatcagcaccgaattcaattgcttgcgcattcattgcttcgtaaaacagctttttcatacaataccaagattgaggtgtattttgtttaatatccggatctgacaaataatctaagtgaatttctttactttgtacacctaaatcatcagctaaactcatagcttttttaaattcatcattagagaataaatccgaattagctacaaccgccaaaacattttctcgtcccaaagttttcacagattcatctagaacaacagttgagtcaattccacctgaaaatccaacaacaactcggtcatacttatttataagattctgtaattgattttctttatctgataacattttttattcccctttacttagacatcaatattttttactaaccgccactaaggctgcctggtagaccgttctaaacggaatatgaaattgctgtgccagctgggcacaatccgcatattccggcatcttcttctcaatatcttgatatgtcgccactttaacttgaacatcaccgtacggcgttgcgaccgtcaggaagtgccgttgcataatagtacgttgccacgtctggtaacgtacaccaatcgtcgtcgtttcttgtaaaatcaacttagtcagtaagtccttatcgttaacgtttcccaaaaccgttaactttgtcgccggccgatctttcttcatctgaatgggcgtgaaaaacacatcgtatgcgcccgccgttaataactggttcatcacgtaccccagtccttcacccgtctgatcatccagattagcttcaatcattaagacagcatcagccgtccggttaacgatttgctgacttagttttttttttcgaataatacggctcgcagtgcattgaaaccacccgtgtcccgtttaccaaacccataaccaactctagttggcacggcattttccggtaacggtccgaattcacgtacgagcgtcttgaccaagcccatcccagtgggggtaatcaattcagtatgcacatccaaccgttgttgaatcggaatggcactaccaactcgcatctgcatcacggctggtacgggaactggcatctgaccatgggcaacgttaataaaaccactaccatcacttaacggtgaagccatgatggtattaatctgcatcaattccaacccaatacagcagcccacaatatcaacaatcgaatccaacgcgcccacttcatggaaatgaacttcagctagtggcatgtgatgaaccgctgcttccgcttgcgcaatttccataaagtactattactgtaattgtgaaatcagatccggtaacaccaggcaagccaagtcaaccagctaagccggttagtccggtaacaccacccaagccaagtcaaccagctaagccagttagtccagtgacaccagatcagacaaatcaatcggctaagtcagatcaaagcgcaaaatcagattatccaacgacctccagtcaagtaacatcggtgaagtctgggagtgcatcacaaacggcaacctcacataacgagttaccgcaaactgatgaatcaacgcaacgtaccatgactttaggtggattattgctattagtaatgactagtctgcttactttcttaggagggaaaaagcgtcgtaatcaagactaagggtggtatgatatggctgaagacttggaaataaaagcacagcttgaaaattttgagaacatgttaatgctgcgaaattatattaacagaatgttaaagtatgatttaagcggcacgcatctttcgttacgtgaatgtcaattactgatgtacatttatcaacatggtcaaactggcactagtgaattggcacaagtatttaaagtgacacggacattaatttcaaagacccttggtcaattgatgcaagccaatttaatacgggaacaggcacatcgaaatgatcgtcgtagagttgacatctcactgacagataatgggattaaacaagttgtagcggtaaaaaaacaaatttcaaataatttacaaagtatggacgcaactaaagaattattacgtttaactgagcagatagccagtttatctcaataattagctgaactgaataatagcttagttgaagctagcaaagaaaggaagccaaatgaagggcttcctttcttgtaatttatagcattgaaaatattagtagcgagctgttattgataatcgagataaggaagcatttggagtcagtgacgagagctaataatttctttaaaattatgtaacataactagttgtaagcaggtcgttatcattatcaagattggaatttacaattgtcagaacgtctggaaattatttaactatgagaaaaaatcagactacaatttttaaccgcaccgtcaaccggggcgcaaaagccattcggattgcagccccgattattaagaagttaacaccagccgagcgaaagcgtcttgtgacactaccgacgagcgggccattgttggttatcgttatctacccgtctttgatgtgtcacaaactagcggtgaaccagtgttaagtgctcaagactttgtcaaagaaaatttggccgatcatcagaatgtgacgagcttgtataacgcgttcaaagattatttaaaccagcaatctgaccttcaagtcagtgaagtgcctttagcgacgctaaatggggctaaggggtattttcaacccagcactaaggaaatcgtcattggtggagatgagcccgataatgctttaaaattgaagacgttatatcatgaatatgcgcatagccagctacacggattaaaatcagcctttaaagatcgaccacgagcctatcaggaagtccaagccgaagcagttgcgtatgttgccatgcaaaatattggcgttgataccagcaactactcactcggttacgtggccacctgggccaaagataaagccgtaatccatagcgctttaagtgagatccagcaagtgagcaacaaagtgattgagcttagcgatggcttaaccaaacaattaggcttacaagaagcaccaaaagagcctgagcatgatttaaaaaagctatccgcccaggatcttaataagtcctatcaaagcttgcaacaacaaattcaacaagcagctagtccacaacagaaagcgcaattaaaaaaccagttaaacgatgtgcaccaagaaatcagtgagcgaacgcaaaagcaactgcaagcatttgctgaacagaatccggaaatcaaacaacccgatttcaaaaatgaccaaagtctaaaacgttagccagtttttaaaggacatgctataatgtaatagaaaaaggaagccttgcgctaacaagacttcccgtgcaagccgcttcaaaggcggtggcattagttaaaaaatgatagttgagtcaccctgtaacctagccaaagttacgcagggcggcttttttatttgtggtgcttgtcgatatagctgagtagcgcgattaaaaacgtgccaaacagtaacatcaacgagagtgtctggaagacgctcattgactgtgaaaccttcctgaagattattccatgttcccatgggcctcacctcgcaagggaaaagacagctaccgcccttaaaacttcctgcttaatctattatacagaaactttgacaaggataccaaatttcatcttaatattgttatcaactgtttcagtgaaagttgcacttaataaggtatttttgtttaatactacgatcaaagtttagcagcaactaaaaacagcttaaaatctctttgtcggtagcaaccagagcttatttgtataattctttaagcttttttcatttaattcaacttttaacaaatttgaatatctctaccaaccattctttagcaattttttctctgtcgttttcatttaattcaacaattccctgattttcttcacctgaaatgtctttttgtagtataactgccatttcagcctgtgttaattgaacgtaggaagctaatgttgatatagagtatgtgaaattaattgcgttccctgaatttgctagaataacagtcctattgcttttagtttttaaaattttatacccaccattgtgtccatagcggggtaatttgttgatcatttgactatttttaaaagtatcgtccgctgaagttacagaaaagctatataaagtatgtttcaaatccaatttttttagttgaagagtatcaatagacttctctccattagctatatacacaatatcaacgtcaattagctcagtatatatatcattagttatttggtacccatgggctaatgcgttagctaatcgtattgcccttttatcagcaactatgactattgcaccacgttttcttaaattacccgctatactggagccaactttaccatagccaataactagtactttcttgcctaaaagcgtcgttccataatctgctaaaaagatttcggatttgactacaatctcatgtccaaccaaaaaatcttcctcaatttttaaagaacttcttgccactgatagtattgggactgatattgaattattggacagcttatcttcatacttttggtagccattttccgtatcctcgattattttaaccaattgacctttaaactgtttctgaatgtcacttaatcttggtacaaaatacccaccaatatcaataattgcaaacgtgtcctgtccgacaattttctttatcaagttaggtgtatcaacgcctgctaattctttcctagaaacatctagtattgtacaagtttttgataaatgtttaaggactttacgatcgatacttttgggcttaggtataaagtacacttcgtagtgttcacataaatagtctataaaatccaaactgttaatcacggcgtgctctacgacaaggattttttggggatcagactgtcctttattaaaaagcgcagcgactttttcgaaatacgatttatctaatagatactcattatgtctcatcttttacacctgtttccatttggaattcagataagaaatcacgcatatactttgttcgacgactggcttcttgctttcccgttctggtattcattgaacttgctaatttcagtagcttttcataaaagtgattgatggttgtacttttgtgatggcgataatcatcgtgtgttttgatttccttcactgatattttgggatcgtatatttcctgtccagcgtgcccgccgtaagcaaatgcacgtgctatgccgattgcacctagtgcatcaagtctatcagcgtcctgaacacatttaccttcgttagaaagctggtaatggtgttcaatgttgtcagaatatgacatatgttggataatatctaaaatgtcttctctagccggagttgcaatattctcatggctaagtataattcgtacttctctcagtctattctttttatctgcagtgactttttcgtctatggtgtcatgcaaatagctagctgctttcacaacatacagaccaatatcagtttcatcttttttaaaatcttctgtatatattttttgagctaacttagccactctttgggcatgaagaaaatcatgcccagttggatcaaaggccatattttctttagaaaatgattttatatcatctaaactcattactctttatctcctttaattactttatttcgtaaagctatcaggcatagggaaagcgtgaatatggcaaccaaaagcaaaatcaagaaattgattgataacccccattttgtccctgaaattacacttccttgttgtttctgcaataaagaaacaatagaggacgatattgcaattccaactgctcctgaataagcttgaaccgtcatataaatcgaattaccatcatttactaacccagcaggtaattgagacaaactataggtcatgatgttactgtagctaaagctcaatcccaccataaaaagcatatatattaaaaccagcccgccaatacttggtgtaaataggttggcacccaaaaaggtcagcccaatgattgtacagccgcttataatgggtaagcggggtgcagttttatcgtaaataataccagcaaccaccgatagtactgcatcaatcacagcggcaggagcaattagaaaccctaccaagccaggtgactgggcaaaaaggatttgtagcacattggggattaagtatgacatactcaaagaactgaattgcaatagaaaaaaggcacttaacaattgcaaaaagcggttgtttttaaagagacttaattccaataatttatggctcttatgcttctcattaagaaggaaaaacaagccactaaagaaagcggttcctagtaaaatcaaattcaatttaaaagagctactattagcagtcaagttaacaataaacatcaacgtcgttgtcaaaaagatggccaagcaaatgcccccacggacatcaaagggaacgtaatgaaccggtgaactttgttcaatactaagctcaccaagcagccaagtaaccataataattggtattaaaattataaatagaaaatgccaatttaatgtgtcctgaattatgccaccatatatgggacccactgctggtgcaaaggcaataactaagctacctatccccataaaagtgccaacttttttctttggtacttgatttagtatgacagcaaacatcaacggtaacgcgattccatcagcaatgccctgacataagcgacctagcaaaactaaattaaagctgttggaaaagctggcaatcaacgtaccgactaaaaagcttaaacacgagattctaaataaggttaccactcgaaatcgttttaaaaagaatgaaccaaatggaatcaaactagttgagactaacatgtatccagtagtcaaccattgaacttgactgatgggtatagaaaaatacgttgttaattgtgggaaggttatgtttaacgctgtttcaaccactattcctaaaaagcttaaaagaccaatcgaaattattgcgctcaatagtttgttgtgtttctcttgaaccaagaattgcacctcccaaacactacatatagtttttcatcacgtattataccactatatatggttcttagaccgttgctcctacatattttcaagaacgaacaatagtttctctagcctttgagaaactacacttaaaatagtcgcaagtccgttatagccatgctataatgtaaacagaaaaaggaagccccgctagaacagggcttcccatgtagagccgtttaagacggtggcaaagtttaataatagattaaataatccgttagccctgccaaaagctaagacggattattttttttgctgacttttgattagctcaacaattaatgcaattaaggctacgataaacgtaccgaaagccagcattaattgtaaagcgtccgacacggacacttaagctactcctttcgttaggatttatgggctttaatgttttaacaccataagcaccacctccgatcggaaatagccaccgcctcaacttctctacttgatccattatacagagatataattcttttagaaacacatttttaaatcagtagtgtacttcatcttgactgaggttatgctgataacatagaatgttcgattgattttgctaatgttattgggggaattaattttggaaattaagtctgttaaacaagtagatcaagtcttaaaggaactgcttgctgtgtatcgtaattcaaacagatatagtgctttcattgacggtcaaggaaatgctgccagattgtactttaggggacaaagccaagaccatggaaatagcaacaatatagccagtttgcttagaaacaatgatgaagacaatgaactagatcatataaaaaaattcccaagtaacatttactcacagggaattacctctaatcttcagaaactgatatgtatgcaacactacggtttgcatacaagattgttagacgttacgtcttgtctttttgtggccttatattttgcaacgtgtagtgattcgtctgatcccggagttatttactgttttcccaatttcttagtacccgctgattatcaagaaaaaggcattgtcccccaagaaacacaacgtgacgaccaattagaaaatacttctttagacttcgaagttgctttagcttatatgaaacctgctgataaaaaatatatttataacgaatcccaaaaattcacagaactaattttttctgatgaaaattctcttcctttagatgatcggtgccgggtactttacgaaatatacgaaaccttatttggaaatacagaagctgaaacgttggaagaattagaacaagaactaaaatgcgaggatcaagtaaatagtttaaattctgttcccacacattattaccaggcttacaaactaatttatccgaaatatatgcagttaaataatagtccacaagtttgccgattattagagattttgaaagcagatagttgcaaagcttatgtaaagccaattgactttacaaaattatttacagaatgcttttttgtaactgcttcccaaatcaatccccgaattaaagcacaacatggttgtttcatgtttcagccctttcctgaaacaacttctatttctacaattcaaaatatgataactcagcaatacgaacctcaaaaaataattgttccagctacctataaagatttgatccaaaaagaattaaggtatctaggatattcacgagaaaccttatttccagatgaagaagcattaggtgttaaatacagtgaaacaataaattcaattaataattctcattaagcgctttacggccagtagggtataccctagtggcttgacttatcttcatgaactgaggatgcctacaaaagttcaatagcattgtccaaattatatgataattatcaatcaactagtaatcagagacccttaagaaatcttaagggtctctgattactaaacttcaataacttcagattacgtatacctttaatgttcgaataaaaaaggtgcctagccgttgcacgactaagcacccataaaaaaattaccaacaacagttgacagataaccgggttattcgtcgttacaatgactaacagaattattggcacaataatctgttcaatggttgtcccagaagattgaacgagctattttagttttgtatccgaacccaaaatcctattaagtcagtcaggtaaaactgcaaacgccctaactggaaaaccaggagccttttcagccttgggaacagaaataaaaatataactaccagtagcaggaactaaatccaaattagctaataattcaacctgataatgattatgggaaagaacataatattcaccaatcaagccatgttcttgctttacagcagtatccgtatcaaaagtttcatgaccatttgctgaggcaccccgttgttcatagatgaatttcaaagcatctaaatcccatccaggataatgagcttgcttcttgtcatctaggttttcaaatttttcttgactaggccaacgttttgaccaatcagttcgtaaagcaacaaacgaattttcaggaattttcccattcttcttttcccattctttaatatcatttacggaaagagaagaatctgcattatttttagcttcattagaatgatcaataacaactagtgggagaactaattctttgagagaaaagttttcgacatacttatcttggtgctcatcaaaatgaattggtggatcaatgtgagttccaaactgccctggaaaagtatattctttgacgtaaaaaccatcagaatgtgtaaaaatggttttaaattctgggcgtgcaaaggaaggaaaacgagggctttccggcccaaatgaatgggttaaatctacccaattaaatgattttaatttttcaacgacttcgccaacagattgtgactttgaaattttagatgtaaattttgtatttgcagatgttgtagttgtcataacgaaaatcctcctaatctttgtttgagaagtctaaacttggtgttttttctgagaagaaatgagtttttgcgactaagattgcaaatcctactaagatccaaataataccaacaatttttgattcgattgataggcttaagaaaatccatgtgctgacagcgaaaccaataaatggtgataccaaatacttaataaatgacgaaactgaaccgtggtctccctttacataaaacttccaaatgaccgaaagattcaacaaaatgaatccgaataaggcaccaaaactaaccagattagaaaccgtatcttgtgaaagcgttagtgatagaattagtgaagccaagcccactagaacaatggcaaagattgatgttcgatacttcttatgcaatttagcaaaagcagaaggtaaaatgccatctctgcccatagcgtaaagaatccgtgaaactgcggtttgaccttcttgaccactggcgaagccgaatgaaagaataattgtaatgtctgctaatttaactaaccatgtgccaccaactcgttgaagaataccgagaaaggcagtattctgattgagattttgataatctggagctacaaatccagccaaaatagtaataacaacaaacagaataccaattgataaaattgaaagaataatagctctccctactgagcgatgtggatcttccgcttcttcagagagcgtactgatggcatcaaagcctaaataactaacaatgacaatacccgttttgggggataaaatattgtgttccatttaatccggcaagaaaatcaagatgccaccaactgcggcgaaattcgccatcagtcaccgctttcaagccaatttctacttgcttttctacgatacgatcaatttctttgttttcaactcttcgaagggcatattcatcaattttattattgcgaaaattatcacgagcctgttttaatttttctggacgtaataaactacctacttcatcatatctgtaggggaaactttctctaattgctactgtcatcttaatcactcctattagtatttttagataaaaaaagcccttatacagaattgatctgtataaggacgatattgtcgtgttaccaccttaattttcacataacttgcgctaagtgacttatcaagtccaaaaaaactgacaatcccattgttttataaataataaggattcattgttacgctgtaaggtgcgttcaccaggttattttgctaacggctcaataacctccagctcaaagaccatattcatcaattcccggcaattcactctcatcaaatgtgaactttcttagtaccgttctaagactactcatcttctcattgctttcattctatcaatttaattaaaaattatagtcaaaaaattaaaatgtcaacacaaaattcacatctagctataatgtttttttgataactaacctattactatcatttggcaaattaaaaggtttaatttgaataagctcatatgaatattggatagtactgcttcacaaaaagtttcaattttaattcgttcagcataggttatactagacaagaggtcaactcccaaaaatgtatttgtggtacacacaactaaagtgaaccccataaattgaaatgaatttctaagttgttaattggctggtatgtttccggtgttttaccggggatatactagccgattttgttttaatatggcaatgagtgtaatagtctacgtaacttgtaatggtaaattctagctctttatagtttttatattgacagttatgaactatgccagccttaataatgcgaagtaaatccttgtggttaacgttgatgatcttgattaatattcacggtacagtgcgtcgtggtaacgactactcgacatgggtactttaataccataacttatttaacattgaatttacgccttagctcagtgattagctgggctttttcgtgatttaagatttttcctttgccaaaacttcgagttttttcaagtatgctatccgtattcgtaaaagctaattttcttcttgaagttgtttaaagttttgggttgtttagctttatctgccatttctaaagaccgtcctttagatgacttaagacgtccctcaatcagttttcgttcccagttcccaaccatcatcggttgctttaatcggaaagaggttgccgttactagatataaggcataatgttcttgtcgctatttgataacattaattttaaaggaacagtcataaaatgtcttcttaaaacaattctctaatccttgaatgccaaaaattttaagtttagtgagccactgataaagcattgcacttccgttaattccgtaatttttcataagtaacaaggacgaagttacctagagatattcacttaacacaattaacatagaaagtatttaattgaaatgtactttctataagggggcaacgaaactttttggaacctgatgttttttatagatgttcaatagaaccatataaaattttgggagcaagtactgtatcaagtttcactggacaactttacatattatgcggattaaaattgtaagcaatatatccttgatttttatatcatttagaaatatagtacctacatctagatgagaaaaaaggacaatgattattgaaatgatgaatgaattatatatattgggtgagctgatggagagttctaagacggcttatcgtttgcaccaatcaatgcagaccttacttggacaccaccgaatgattagtttcggtgctatttatccattattcgaacgtttggaaacaatgggctacattaaattgactgtaaaaggccatgacaaacgattaacaaaattaagcaccattaccaaaaaaggtgaagcacatttcttggagttgatgcatgaaccggttcccaaaggggcgcatacggacgacattttccaaataaagctgggttcaatgcaacatttacccttagtggaacaacaagatttactggatcagtacatgaacgaacaagtggctgttgctgatgattgccaaatagagcttgaacacttaagtcaacatgaatgtaagaatcactggtatgtggcacaaataacacagttgcgattgtgccgggcacgggtgacacaacagtggattagagagcttaaaatagctctgcaaaagaaataacctttacaatcacatggctacaaaagttttatgggaattatgaattggacgatggtcacagcattgtaatcaagaatgacgaaattttggggattgaatcgcttactgatacactacttgttaataacctttacttaattacagttaccatctctcttcgtaattggctcgctaatcgatatgtaaaagaaaagaatgtaggtgttgaccgtcagcctatttacgttaagcttcttttgtgtgaaaactattagaattaattttacagtctaactcaactattactgatatgctttgatttttcggctaagttgtttagcgttagcttgtactaaagggttcaatgtgattaaatgattttaatcacatgaagagaggaagcaaactatggttaaagctaagtaccgtgtcttagatgtgcttaaacagttagtagctgacaatgagactaatatttccacggaaatggttgcaaccgctgccaaaataacccgcggggtaacaagcgcttatttatcgcaattacataaagaaggactagttcggaaatatggaacaaagccggtgtactggaaattacaacgacgaacagatatatttgatcattttattggtgccggtggtagcctaaggcaggcaattattgctgctaaatcagcaattgattatccgccacatggatttccattgatgattacaggaccatctggcgttgggaaaagttatttagcatcactgatatttaaatacgctcagagtaatctggtgatcaatcaaaaagctaagtttgtgacattgaattgtgctgattatgcgaacaatgcagagttattatcatcagttttatttggctatcgtaaaggtgcatttacgggagctatccaagataccaatggcttagttgaccaggctgatggtggctatttatttttagatgaaattcaccgactaccaattgaaagtcaggaaaaattattcaccttattagatactgggacattttatccattgggagaaaatcaacaggcacatcacgtgcaagttcgctttatttttgccactaccgaagacttggataattatttgctacaaacatttcgtaggcgaatcccattaaccattcagctggcttcttttgccgaacggcccctactggaaaagtatcaattgatattacacttcttttatcaagaatcccaagctgttcaaaaaaacttgctaattccttatcaagttttgaaaaagatcgctgctggtcccgttgctggtaatattggttcaattcacaatcaagtgaaactaatggtggcggcagcctataggaagcaagccaccagtaatcaaatcgtggtggcagcaaaacaaacgaatgatttacaactcaccgtcagttatcagaagtctgagaattttgatcagattttagcgacacaaacacaagctgggattgatcaagtcttttcgcaattactattcaatgaacgccaggaaacgccggtagctgaccaagtattgattctgcgtggctatttgcatgatgttgaacggtcgattcaaaacttccaattaaatatgcaagtagtaaccgtgatggaagcgcggctaaaagtagctttacggcagttcaaacatcggtatggtgttcctgtaaatgtgaatgctagttcagtgacggctacggcgcagttactagcaacgatgctcagtgggacacaagttattaagcaagctcccgagctacaacaattgatcaatcagcattatccacgaactgcttatttagctaaacagattgcccagacattgtcagaacagtcattaccgatagctgttgtagaagttccggtattattcttgatactggcaccgtacttgaagcaaatagagcgcatcaaaatgttagcgattttggtatcgcatggggagacgatggcttcaagtattcaaagcgtggctaataatttgtgtgggacatatatctttgaaagttttaatatgccaattgatgtttctgttaaagaaattagccaaagaattaataactttgtcagtgagcaaacaatgacgtatcaagggactgtcttgatgtttgacatgggttcactgagtcagatgtataaagagattaagccactgttagcgtctgatttattagtcatcaataatttaactacagcaacagcactggatattgggctacagatgcaacatggtgattttaagcaactggtacaaaaagctgaatcttatcgcaatgcgattcaagttcaatattatgaaggcttgtcgcaaaaacaaaatatcattgtttcctgcatgtctggtgtgggcttatccaatgaaattaaacggattatgaagcaaaccttgcagacggatacggatattatcacgatggactataaagatttaaagcacactttgactagtcatggacatgaatactttaaaaatacctacctaatcttaacgacaacagatattgtacaagctaaggttactccgattgttaatatttacgatattatggatgcggttggtgaacaaaggttacaagctgttttgagtaggattggagaacaaaagcgtgatattgatgcccttatggaaaagttattacaattctttacgattgaaggaatcagttccagattacagtttttgaatccacggattgtgattaaagaagtccaagggattactaaaaaatatgaagactattaccacttaagcttgagcggaaaaatcaaattaaatctgtatatgcatatttcgttgatgttagagcgaatgttggtttctaaccacaatgacagtacccaaagtttggcgacacctcaaaagcggtccactcagaaagcggaattttattcgattacaaagaacattttccacgatgttgagattaagtacaatattgttgtgaatgactatgagatttcattgatgtatgaattattaagggattttttgaattgaatgtgcttaaagaagtgcttgagtttttgagcacttcttttttattgcagacaaaaggctgttatatcagcgttcataaaagttggcacggtaattgcttctaagtaagtgtaaagccaaatgagggagtgagaacgcgtgaataaatttttaattgcgtcacatggtgaactagccaagggaattcaaagtacggtcgaattatttgccggaaaaaataatgcaattagttatatttccgcatatacggcggctgacgaagatttaagtatccaattaaccaattttgtttctagtgtttctgcatcagacacagccatcatctttactgatttatatggcggcagtgtgaatcaaaaaattacggtcatggctgctggtaaaactaattttcatattatttctggtttcaatttgccagttatcttagaaacagtgttgtacaccggtaagattaatactgattttattaattgtgtggtcgaaaaaggccgccaaaatttaaaagttgttgatttacaaccagcaactgatgatgatgttgatttttttgactaaggggtgaatgatatgattcaagtattacgagtagatgaacgattggtacacgggcaaattgcgatggtatggtcacgtgcggtggatatcgatggtattgttgtggctaatgacattacagcaactgatgaaactcaaaagatggttttaaaaatggcagtaccaactggtatcaagttaattgttaaatcaattgatggggctgctaagttgctgactgatccacgggctgacaagatgaaattgatggtgttagttaggacagttgcagatgcggttaggttagccgaaatgattggaaagattaattatgtcaatattggcaacgttggtaaggcagttcaagaccaaaagaagactttaacccaatttgtcatgctaacagatgctgaaattgacagcttaaaatcactcattaagttatacccagaaacagccttacaaaatttacctacggatcgtaaagaattggctagtggttttgttagcaagttgtaatcagaggaggaaaatagcatgctctatgaagctttgattgtttcgttaatcgtctggttaacggttgggggccaagaattacttgggctcactcaacttggccggccaattgttattggcccgttagtcgggttagcattaggagatttgcaaactgggttgctcttaggggcttccttggaaactattttcatgggggttgttaacattggtggggcaagctcagctgaaccagggctggcaagtgctttagcggttgcatttgccattaaaatgcatggtggtttgggtgtggcattaccaattgcgattccaattggtattatcggactacaaattaaaacgttgatttacgtggctatcgtcggaccgtttgccagtaagtttgaccatctagctgctgagggtaaccaaaagggcattgttgggctgcattatgggttgtggacactccaatggtttatttattcattaattccattttttgcaattatgtttggttcacaagcaacccaagatgttttaaatatgattccaagcgttatcacaaatggtctaacgatagctgggaatttattaccggctgttgggatggcaatgttgatgaagattctttgggaaaacgatatttcggtgtactacttcttaggattcttaattgtagcctactttaaagtaccactgattgccgttgcggtaatggcaattgttattggtgtagttaatgggcaacgtgattttcaattgcatcaactggacaaaaagttatctgaacggccatctgtcgtcacgactggaactagtgattcgatcggtcatgagcctgttgaagatgctgacgacaccgatttttttagttgattggagggataagaatggctactactaatttaagtacgaatgaaaaaaaattattacgacaaatgtattggcgttcatttactttgtattcatcagtgacaccggccaaacaaggtgcttctgggtatgaatacgcgatgctaccatttatcaatcagttctatgaagatgctgaagataaaaagttagcaatggttcgacagatgtcatacttcaacacgaatttagcgatggcaccgtttgtgatggggattactgcttcaatggaaaaagaaaatgccgcaaaatcaaactttaatgctgattcgatcaacgctattaagactagtttgatgggcccgttggcaggtattggagactccattttctggggcgtattgaaagcgatcgctgccggggttgcaattgggttagctaaatcaggtaacttcttagccccaattatatttctattgattttcaatattccagttcaagtggtacggtggtatggcggacgtttgggctatacattgggttcaacttacatttctaagttgtatgagaatggattaataaatattctgaccaaagctgctagtatcgttggcttaatcatggttggtgccatgactagtaatatggttatttttaaagttaaatggaatatgatgatggctggaaagactatcttgaagactcagccagtcttggatgaaatatttaaagggttaattccgttggcaatcactttaggatgcttctatctcttaaaaaagaaaaatatttcaattaattacttgatttttggcattataattttagggattgcagtgtcattattaggcattgcctaggtgaatgcgatgaataaaaaatggtggcaacaagctgtaatttatcaaatttacccaaagagctttatggatagcaatggtgatggcattggagatttaccagggattattagcaaattgacctatcttaaaaagttaggggttgatgcattgtggttaagtcccgtttatcaatcaccacaagttgataatggttatgacattgccgattatcgccacattgatccgatgtttggcacagatgaggatatgtatcgcttgattagtttagcacacgcgcaaggattaaaaattgtaatggatttagttgcaaatcatacgtcggatcaaagtgtttggtttcaagagagccgtaagtctcgcgataattattttagcgatttttacatttggagagatgccaaatctgatggtagtgaacctaataactggggctctaactttggaggatcagcttgggaatgggaaccgcagcggcaacaatattatttacactactatgctaaacaacaacctgatttgaattgggaaaatctgcgtgttcgacaatacatctttgatatgatgcgtttttggaaggctaagggtgttgatggctggcgaatggatgttattacttcaatatcaaaggatcagcgctttcaagataatcctaacccatttaaacaaacatatgtgacaggcaatcaagataatggaccacgaatgcatgagtttattcatgacattaatcgagaagtcttgtccccctttgaaatgatgagtgttggtgaatcaccgtcttcaactagtttcgatgctcgtaaatttgttgatcctgaccgtgaagaattagacatggtttttacgtttgaacatatgcatgttgaccgtaaaccacatggtagaaatggacgttgggatttacagccattggacttagttgcattgaaacagatcttgagtagttggcagactaatctatggcagcacggttggaatgcattgtattttgaaaaccatgaccgtgcgcgagtcacttcacgttggggaaatgatcaacagtatcgctatgagagtgcaactgcctttgcaacggtactacatggcctacaaggaacaccgtttatttatcaaggcgaagaaatagggatgactaaccctaattttgaaattaatgattatgaagatatcgaattattaacgaattatcgtgaaattgttcaagaaaaacaaaccatgactaaagctgaattcttggcagctgcccataaaattagtcgggacaatgccagaacccccatgcaatgggcgccaactagcaatgcgggtttttcaagcgggcatccttggtttaaattaaatccagattataccactgttaatgtacaaaatgaccaaagcaacgaaagatcagtttttgcatattatcaaaaattaattgaattacggcatcgatcacagatattggttgctggaacttatcaattaaattgtccgaaaaatacgcgaatatttgaatatgagcgtatttaccaaggggttaaatggacgattattgccaatttaagtaatgatgagttatcaatttcaacatactttcccaataaaaagtatcataagtttattttaaagaattataaagatagaaaagatttagaatgtaacttacgtccatgggagagctttattattgaacaagaaatctaatccctattactctgtttcaagattgtaagttgtatctcaatatgtgaagtagacccccaaggttggattttgtgttcaaccttgggggttactatgttcagatttgatttttgatttcacactaaagtagttactgcatatttcgccagaaaagattcaacatctttgactaaataatactgaaagaaaattttgtaccatgatctagacaatgattgttgaatagtccaaaaatgtttttattgagaccttgtttcgagtgcttaaagctatattatggcccaataactgtcgttataatcagattattcaaaaaggacccattatcgatacttcaaagccaaaatgaaaattttatatatagaattttttaatgtctaattggctattatgattagttacgaagatcttccatcacaactggtattatctccaaaaaaattcttaattttatttggcctcatcatcacataattaagttattagctaaaaacgatctcctagttcctttaataactagacatattcgaactatttgaaacgcttcttttaagtgcaaatatttcttggcaaaaaaatagtttgaatgatcagcattatgagtacatgctaacgtactcaatcggcagggttggtgttcttctggatactatttttaagaatggttcacccatatcttcagatcaactcaacaaagtattaagtgcggcgttaaaagaaattgctatccaagttaatatgcagtagcttaaaatcagcacatctttagaacctataacttaataaatcccccccttggaaacattttgagagcgtaaaatatcttgtgtaaatgcataaaagatttctgaattgtatagaaatagggaatgccttcccttatgatatttagtaatcacagaaaacatcacaggaggcattccccatgaatgaacttaccacagaaattatcgctgcactatcccaaaagcaagatttggacgaagtttttcgtcaccacctcgaaattgcaattaaccagctgcttcaaaccgaattggcagagtttttgggttacgaacgctactcatcaagagaccctacacatttgatttgtcgaaactttgttcagttttcaaaggtctaaatcgttcgttgattacctcaacgcaactattaaagtttatcatcatcagaacaagctgtcaacatctttttataaattattttgaataactattcaatgtaaatgctcacatcaatttgaatattcataataatgagtaatgttgcatatcgctcttaacgacaagaaatataataccaagaataacgacccgggtcaaccctttttatgaattaatttcagaaaagttttaaacaccgcttaatgtcgcaatagactatattttacggggtttttattaagatagcaagcaaaagttcaataaatctccctttaattttcaacgactgtttttcaaagtaaaccaacgctagcataatgaatattatttcgctgacaatctaccaaatcaagacaaccaatcagtcagcattccccacctcatcaccgtactttatcagttcacaacatccgcgacgcgcctaccattccaactttgcatttacttgggactccaaaattggtaatacttcatcgttcaccatcagtgtcaattcacactgcgcaacaatcggcttaataatagtgtaccgcgctgtggtcaaaacaagtggcagcttatttccgcaaccaaaaagggataacgccgtcagcgttatcccttagttgatacgagttcgattaatcagaactactgcttgaactactactactgtcacttgagctagacagttctggtgcatccgtcttatacagactctccgttgatttgcccttatgcttcgagagaacactcgtcttcttctcagcttggatctctttcaatgatttgagggtcttagtcagcttataactatagtccgacttattgaccttcttaaagcccttaggcgtgtagaaccgtagtaagtcaccctggatgacccgatcagagagtgagagttccgtcgtcacatgattttgcatctgtttgacagtatccttctgcttcgtcgtcatatccgttaacttcttaccggtcttcgaatcatagactgtcccactgatcttcgtatatgtcggtgagacaaaatccccgttccggaaagccactgtctggttatgctgtttcgacagtaagtccgttccgaactggatgtagcccttgttcttgatccctaacaggtcaaaaatcgttggcaacgcatcaatttcaccaccatacgtgtggttaataccgcccttgattccttcagaatgaatcataaatggtactttctggaattgagccaagtcgaaactcgttaccgactttttacccaataactgtgcaatggcagccttatggttgtttgaaatcccataatgatccccataaagcacaatcatactattcttatataagccggccttcttcaagtaactaatgaattcggcaaaggcttgatcaagataatgggccgtctgaacgtagccatcaacggttgaatccccggtcgtcgtcttatcgatcgactggttcttcttatccaattcgtatggatagtggttcgtcaacgtaatcagctttgcgtagaacggttgtggtaattgctccaaatacttaacagagtctttgaagaagattttatccttcaagccataaccaatattgtagtctgacttctctttatagtaagaagagtagaagaagtagttatacccccacgacttatacgcgttatcccgattccagaaactagccacatcaccgtggaaagccgcagtcgtatagcccttttgtgacaggattgctggcgctgcctggaacgtgttcgacgtcccatactgcgtcatcgctgacccggttggtaaaccaaacaaagagttttccatcatcatttcagcatcagaggtcttcccttgcgccacttgatggtagaaattatcaaaactcaaagtactcttatcatgatagaacttgttcaggttcggggtaacttccttaccatcgaccttataatcaattaaaaattgctggaaactttccaaatgaatcacgaagacgttcttgcccttcgctttaccaaagtatttgacgttctcgccagcctggtttttcttgaggtaggctagcacactcttcatatcactactacttgcttgggcgcgcgtcgcactttccttttcggtctgatagaagctataccctgcatatgtgttgagtcccaagtacttaacgatgtagttgttatcaaaagtccgcgtcaataaatctgaacggtcatgttcagacatgccgaggtcaacagcaaacaacgccaccccaatcatggtcagtgttgccgcataccgaattttgaaaggccgtggatcgatccgaatgaccttgaaggctaataacagaatcagcaacacgacatctgcataaactaggaagtcggttccatgaatgatctgtcccaaactctttccgaggttattactagcagcaccggaactcttaattacccccgccgacatgaaatcagagaattcccggtaatacaagatattggcaaataaccacgtcgtctgtagggcgtcaatgatcatcataatccaatactttaagcgaccacggaaatatagggcaataccgagcagcacgatcgctgtcggaaatggattcaagaacaagataaattcctgaacgggtcccttaacccctaaagtaaactcgctcttataagcgatatatgtctttagccaaaataagaccacggttaggaggtaaaagcccaacgttgtgttgaccttcccaaccgtgttttttataaatttaggcatggtaatttcttcctccgttattgctattaacaaatccatattataacggttgcgtactagttagcaatatcttgaagatttcttcaaaaattcttcaacattacaacgcgtcataatatggatctatcgaaaatctatctggattttgggggaatctagttatccgttagcaaatcgtataattcaattgccacgaggtcaatgttatcaaattcaaacgtttggtctggattgaattcttgtaacgtgtacgtcgaggtagcgggatcatacgctacttgcccacgttgaacgccttccttttcgaaccgccgtgattgcacttcggttgcttcagttgtgcgcatggcttctagtcgtttgagaattgctgatagttcagatttatccattatactaatctcgctccttcaagttttgtttacattctagcaaaaaataggactaataacacgtttttttagtagaaagcccatttttaccacaaattttcacacttataattataccctaacttcctgctaagacggtgagaagttgtgctaaaattagaacaacttataaattaaaggagttcggatatatgacactatttagagacgatctcaatgaaaccatcagtcacattcaagtttcaaccatccgccagtttgacgaagaagttagtgcgatacctgatatggtcaagttaacgctcggtgaacccgatttcaacacgcctgagcacgttaaagcggctgctaaaaaggcgattgatgacaactactcccactatactggcatggcaggtctgttggagctacgccaagcggccgcccactttcaagagacaaagtacggcgtccactatgatgctgaagaccaagtcttagtgaccgtgggagcgactgaagctatcgcaactgcattaacgacgatctgtaatcctggtgacgccattatcattccgtccccaatctttccagcgtacatccccatcattcaagaagcacatgccaagcccctcttcatggatacaggtgttaacgattttgtcattacgcctaagatggtcgacgattttattgctgctcatcctgacgagaacttcaagggaatcgtgttaaactacccgaataaccccactggtgtcacctatgttgaagatgaaatcaaagcgctcgccgactgtttccgtcgccataacttgtgggtcgtatccgatgaaatttacagtgaactgacttacggtagcgaccacgtctcaattgctaaattcattcctgacgaagtgatcctgatcaatggcttatcgaagtctcatgctatgactggctggcgaatcggcttcctgtttgcctctaaggaaatgacggcccaacttaaaaaagtccaccaatactacgtcactgcagcaaccacgattgctcagaaggccggtgttgaagccctcaccaacggaatcgatgatgcgcaaccaatgcggcaagaataccaagctcggcgtgatttcgtttatcaaacgatgtcgaagctcggtttcaaaatcgcacgtcctaccggagccttttatatcttcgcgaaaattccagctggctttgaacaagactcgatggcattctgtaaagacttagcacgcaagaatcagctcgcgattattccagggactggttttggtgccgagggggaaggctacgtgcgtctaagttacgctgctagcatggaaaagctccaccaggccatggatcgcctcactgcatatatgcaggaacctgctaaccgtatcaactaagcaacgacagtccaccagctaactgtcctagttcatcactgttagtcatttcaatgactgaattggattcaactcaaaaaggtgcgccaactactcgtaaattacgatagttggcgcacctttatttgtcttcagcatcacacgatctattaagcgagcatcactttgcgaacgcatacgtgcccgtggtggtccgttttgcgggcgctgttgcccattgaagtggtccaagcatcgtcagcgcttcaggcgtccgataaatgacttccttcgccgttcctgacaatggatccgtcaatcgcaatttaagaacggccgtattagcagccagataatttggcgctgtccgatgtaatggccacaaagcaattttggtctgcgtcattggctgcttactattcacccacagttttgaattgtacttcgtcaccagacgcactttggtctgcgtccccggaatctgataattgatgctcttaggcacaacctgtttatactgctcggtcgttttgagcatcagccgcaagttgttgttcgccgtaaactgccacgcaccgccaagcgttgttgcaatcatccggtggccgttctgccggtatgtagcgactaagcaagcaccggcctgattcgtataaccggtcttcagtccatcgactggcacgcggggatcatagtactcggcgcccttcaggatctccaccgaagttgggaccgtatacttatgaattttgactgaacgttgattagcaacttgaataacatcggggtaagcatcaatcaaatgttgtgcaatggtcgtcacagcccttgctgacaccagattttggtcctgatcgctggttcccttaatttttaaatcgtaatttttcaaatcagtattatcaagtcccgaagcgctaataaaactcgcatccaaatgccatttggacgcttgttgattcattaatttaatgaacttatcattactgccagcaacatactcccccagcgcaatggcaccactattcgaagaccctaccaaggtagctgcgaatagctccctaaccgtaaacgtctccttggcgggcatcggcattacggataaagttgcactggttgccatcttacggacatttttgcgaattgggactgcatccgtccacttgatctgaccatgctcgatggcccgttcaactaaatacagcgtcatgagcttactcaaggacgcaattggtaatttctgatcggcattctgcgcataaacgacctgaccagacttggcatccatcacgtaggcggctttgacctcatccgccttactactggtcgcgtgtgccgctacattgcagctcaacaccccgctgactgtcgctgtcaacactagtccccataccaaccgttgtttgattaactttaacatagtaccttcctttaattcgtaaccgcgaaaaatgggtcgaacaatgatgtcggcccattaaaattactgttcttgtgaatccgaccggctaggtgccgcaatcggaatttcttctgctttttcaggccgcatcgccatggcgatcatccctaagaatagtcctaaataatacgttaagatccgccagatcagcatcgctaaaatcagcttactgtggctgggaatgaacttagcaaacaacgccgtgaaaccaaattcagcaccaccggccccacctggaatcgggaatagtgatgtcactaagaagatcaacacgttcaaactagtcaccataatcaaattaacatcatcgattcccattgcccgcataataaaatacggaatcaggtagtaaaacagtagctgtaagaaggtgacgatacaaacttcgaccagcatccgccagtccttggtcattcgaacgctttcttcgtagaacgaatcgattttttcactaatattgttttcgaacttggcaaatcgctcagctttcataaaccagctgaccgggaccaagacgatcttcaccgctcgttttgtaaagttgtaccagtacatcaccagcaacagaccaacaatcaccgcaaagtgaatcagaaaacctaacaaaacgtatagtgacaggtaacttaacttttcagctaaataatgaaaaccaattaacatggcgaataagaaattcaataccaccatggcctgaaaaacaacaaacttcatcaatgcaactgaacttgcccgcccagcgtcaatccctgattgtgccatcacgaagatttgggcaggttggccacccgaagaaaacggggtgataccgttgaatagttgctcggctaaaggaacgcgcagggcactcttaaagcgatagttccgataacggtgcctgacaaacttttgcaccaccacggcttccagaccgaagtatagtccgacacaccctaacgcaactaataaccaccaccaattcaaagtgagaatatcgtccattagattgctgagtttgacattgcgcagtgagtaccacgaaatgccgacgcctaacgcaaccattacgagtaatgaccagatattttttcttgtcattgactacccctcttttgcctgttgcaaataaaaatcatgccaaactttggcaaggcgctcttccgaataatcctgagcagccaaaaccgccttgtcatgcaagaattgcaacccggctggattatggcgtaactggtcgatctgtcgttgcatatcatcaacatcactggccgcttgatagtagccatcaatgattgcccggtacaaatctaaatcccggagcaatactggtgtcccacaactgaaagcttccaacacggacatcggaaataactcgttataagaaggcagtaagaaaagatccgccatattataatagtccaccaatttctcacgaggaacgatgcctggaaacgacagattagctggcgggttatccaccacctgcttcaattcctgataaccatccgtaattcggccaaacgagaacccaccggcccatacaaactggatatctggattctgctttgcaagcgtaataaaatcaggaacacctttccgatcctgaatctgaccggtcccgataatcatgaatttattttgatcatagccgtattgttggcgcaagcgcaactgtttagccttagtcatttcgtaaaattcacgtttgctgacaaaattcggaatatacgttacatccgctcttttgatatggtatgcttccaattttggaatgaaggtcgggttcaccaccacaatgtggtccatccgcttataaaatgagattaaataacgattgaaaatcatttggaatggtcgtggcaacttcaagctaccctcgagcgtctctggtaagaaatgcacgtaaccgattttacggcctcgattaggcataaacgtagacaggtaaaacattggattaaccgtatggtaatgtgaaacggcggagcgcccatatcgattgactttaatattaaattcatcctgccaatgggtccgcaacaaccgcatcaattctagataggcgctgccgactccctgacccttgacggagtcagcttttgaaaacatggtaatgtctaacataattcgtccccttacgcgtcatacgtcgaataagcatccccggtttggcggtgctcattgacgatttgacacacgttaattactaatattcgccgatttatccgctgattcagaatacgccagctgtacgtcttgatagtagttgatcacttgcttgccgaaatactctgcggaaatttggtaaagcttcttctgccgtggcttgggatcgttaaaagtattgggatgttgtaaataacgcacaacatccttgatcagatcggtctcacttgtaaaggtcgtccccagtgacggatcatcaagtaattgatccgtgtacggactagcagccactaccgttttaaggcccgcagccattgcttcaatgtacgtcagcccctgtgattctgagttcgaagccgaaacgaacaggtcagccatctggtaatagttataaacttcatcattatcaatttcaccggtaaattgtacgtgcgccgttaagccggcgtcttgaacctgattttccagtgtttcacgtgccggaccatcacctacaatcaggagttgggcattcggcacctgttctaagatcgccggtagggctgcaatgacttcgtgaatgtttttctcgtaggccaaacgactcaaggaaagtaatactggcgtatcagactgatagccgagtctttgccgataatccaccgtcgactgctgctcgtactgattaatgtcgattccagtcggaataatgcgaattggcgctttaacgccgtagcccgtcagtgtatttgcaacccgctcactcggtgctacaatcccgttcagatgataacaatacgcccgtgtggcctccttaacgtggtatggctttaacaacttaccattcgcaatataatgtagataatcctcatacatcgtgtggtacgtatggatacatgggacttttaattgtttggcaacaaacttaccaatcatccccatggagaattctgtctgcgtatgaacaatatccaggccaagatccttagcaacctggtaagccttaaaaagcccgcgaacggcgatgcgccgatccgtgaacgaaacaaatggaatactcgtaaaccgaaaaatattgcgttcataaatattcttatcaacatggggatccgtggtcgtaaagatatagacttgatgaccagcccgttcgagttgattgcgtaacaccttgattgacgttgcgaccccactcacttgtggatagtatgtgtctgtaaatatcccgatattcacgtagattctccccttatttccatcaattaaccgtgctgctaatcgatgttgcttaaccgcgcttagatcattatttcatgatcatcacgaattcgacttaatgcctatattataaacattatattggttaaatatccgagttgcaaataatcttaatataaattaagagttcatgacaaaatctatctgaccagctacacctatagaaaatgaattcgaaatgatgaattgtaatcgctaggcatcactcaacaccgccattacatcgtttccactacaccaactcttcaccgtcaacagcgagtagcaatgtgccctgtgtccatcattgactagcgcggtcgcaactatggacaattgtcacaatgcctaaatgtccagtcaattcgcgtcatgcactgtgccagctctcatcataccggtgcgggtagtccactcccccgtcgtgctaaacccggggctagtaccaactggttaatgacccgcatttacccacaaaaaaagagcaaatccgcagatttgctcttagtttgattgtttatttaccgaagacgttcttttcaactaattctttgacttcttcgttagtaacacactcgttaagtgccttatcagctaatttagccatttccttagtatcaagtttcttcattaatgaacgtgtcttaagcacggaagttgaactcattgagaattcatccaaacctaagcccatcaataatggcaccgcaatctgatccccagcaacttcaccacacatacccgtgaagcggccgttcgcgtgagcagcgtcaataacatgcttgatcaaacgcaacaacgatgggttgtatggttgatacaagtatgacacttgttcgttaccacgatcagcagcaaatgagtattgaatcaagtcgttagtcccaatactaaagaagtcgacttccttagcaaactggtcagctaaaatagctgccgctgggatttcaatcatgataccaagcttgatgtcgtcagcaacaggcgtaccagctgcaaccaacttggctttttcttcctcaaagatagctttggctttacggaattcgtcaagcgttgcaatcattgggaacataatccgtaattgaccgtaatgtgacgcacgtaataacgcacgtaactgggtccggaagatgtcatcacgatcgagggaaatccgaatagcccgataacccaagaatgggttcatttcatcaggtaatggcaagtaaggtaattccttgtcaccaccgatatccatggtccgaacaataacgggtttgccgttcatcccttcgacaaccttcttgtaagcttcgaattgggtatcttcgtcaggtaattctgaactgttcatgtacaagaattctgaacggaataatccaatggcttcagagccagcatccaaaaccccatccatatcgtcaggtgtcccgatgttagaagctaattcaaagtgcttgccgtccttagaaacggtggcctcgttcttcaacttagcccattcagccttttgcgcaacaaagtctttagccttttgttggtaatcagcaacttcagcatccgttggggctactaaagcgtcaccgttgataccatccaagacgaccgtatcgccttctttgatatcagtcgtggcagattcagatccaacgaccgctggaatttcaagcgtccgtgacatgatggctgaatgactagtccgaccaccaatgtcagtaatgaagcccttaacatacttacgatcaagttgagctgtatcactaggtgttaaatcgtgggcaaccacgattacttcggagtcaattaaagctggacttggtaaggttacccctaacaagtggcttaagacccgcttcgttacgtcgcgaatatcaccggctcgttcttgcatatatgcattatccgtcatcgcttcaaacattgaaatgaaagtatcagtaacttccttcaaagcttcttcagcattgactttatcatccttgatcttaccttcaatttgtccgagcatttctgggtcagacaaaatggtgatatgagcttcaaaaacttctgcttcttcttcacccaagttttcaaccgctttgtctttaatgacctttagttcagccttggaagcatcgaaagcgtcatgtaaccgtgcaacttcagtatccgtatcggaaactgttgtcttttcgaatgataaatctggatcaactagcatataggccttagcaattgcaacaccatcactggccgcaattccttttagtaccttttcagccattattcagataatccttctttcttcatcgtttcagttaaagctgcgatagcgtcggcttcgtcggcaccttcagcagaaatggtaacgtcagcgtctttaccaacaccgagtgacataacacccatgatggactttaagttaacggacttgtcttggtattgcaacgtaatttctgagttgaacttacttgctgattgtaccaataaagttgcgggacgtgcgtggataccagtgtctgcgataacgtgaaattctttcttttccataactattcgatctccttcaagataaataaatttaaaattggttccgagtcaattcgagttgccgccaacacgtatactcaagagcccttaataatgatgatagcaattatccaattaaaatacaagccctttcattcaagctaggcctattaattggttgtcttaccatccttctcgaaatggtaaacaatgcggccatctaagtctgccgtaccaatgactcgtttacgatactcatacttcatataggcatcgtgaaaagccataaattcatccggcgttacggtaaaactgtcgcgttcgccatgacgcaacgcttccattaactgggtataatccgttgccaaacaattaccgcctcctcaaagttaggttgacacattactgcatcattattttgatatttacgaacaaagttctccgccgctcactggctgttgacggtcaccaatgaaaaacgatgcgctgcaaacatcaaaactggtcaggctcgatacatgcaaaaaaaccgctttgtactataatatagacagacagttacatcatcacttatcctaaccagataattaatatacaacgaatccggttacatgacaagctaggagttgcgactatccagactattcagaaataattgaatcaatcagccattgcgaattatcccggccgcacgtccagttttgaccctgaggcttttcacttgcaacagtccgtaaattcgctatactaatagtcaaaggtcaacaaaggtcaaagagccgatgaacctttaactatgatcctaatcgatttagttatatttctgatgcgaaaggtgtgtgacagcataatgctttgtgacaattgccataagaacgaagcgacgatccatttatatacgagcgtcaacggtcagcggcgacaaatcaacctttgtcaaaattgctatcaactgctaaagaatcaggaacagcaaccaaataacggagttggaggtgctgatatggcacaagatccattcggttttggtggtcttgacgacattttccgtgcaatgcagggtggcgttgatcctaataacgcttaccggcaacaacagaccccaccgacccagccagctggtcctaatggcggcaatcgtcgtggcaataacaacggcggtggcctccttggccaatacggcttcaacttaacagcgcaagctaaacagggcaaaatcgatccagtgattggtcgcgataccgaaattaatcgggttatcgagattttgaatcgccggaccaagaataaccccgttttaattggtgaagctggggttggtaaaacggcggtcgtggaaggactagcacagaaaatcgtttctggtcaagttccacaaaaactgttagataaagaaattattcgtttggacgtggcttcccttgttcaaggtaccggtattcgaggtcaatttgaacaacgaatgcaacaattaatgaaggaagttcaaagcaatccgaatatcatcctcttcattgacgaaatccatgaaatcatgggtgccggtaatgctgaaggtggtatggatgctgggaacgtcctgaaacccgcccttgcccgtggtgatttccaattagttggggccacgacattaaacgaataccgcgacatcgaaaaggatgccgccctcgcccgccggttccaaccggtcacggtcaacgaaccgagcgtggaagaatctatcaagattctcgaaggtattcagaagaagtacgaagactatcatcacgttaagtacgatcaagatgccattgtggcagccgtcaagttgtcaaatcgttacattcaagatcgtttcttacctgataaggccatcgatttactcgatgaagctggttcacgtaagaacttgacgttgaagacggtcgatccaaagacgattcaagaaaagatcgacgaggcagaaaagcagaaacaggacgccttgaagaaggaagactacgaaaaagccgcctactatcgcgatcaagttgctaagttagaaaaagctaagcccgatgaaagttcagaccagcctaataacgatactgccactgtaacagtcaaggacatggaacaaattgtcgaagaaaagacaagtattccagttggtgacttgcaggctaaggaacaggctcaaatgaagaccttagcacccgaccttaagagtacggttattggtcaagaccaagcggttgaagcagttgcccgggccatccggcgtaatcgaatcggtctgaacggaactggccggccaattggttccttcatgtttgttggcccaaccggggttggtaaaactgaattagctaaacaacttgctaaggaactgtttggttcccaagacgccatgattcggtttgacatgagtgaatacatggaaccacattcagtagctaagttgatcggttcaccgcctggctatgttggctatgaagaagccggtcagttaactgaacaggttcgtcgtcatccatatagcctagtcttactagacgaagttgaaaaggctcatccggatgtcatgcacatgtttttacaaatcctcgatgatggccggctgaccgactcacaaggtcggactgtcagcttcaaggatacgatcatcatcatgacttccaacgctgggactggcgacagtgaagctaatgtcggttttggtgccgctgctgaaggcaagacgcacgatatcactagccggttgacggactacttcaagccagaattcttaaaccggttcgatgacatcattcaattcaacgctttatctaaggaaaacttgatgaaaattgttggtttgatgatcgaagatgtcaacggcatgttagctaaccaaggcttacacgtccacgtcacagaacctgtcgaggaaaaactcgttgaactaggttacaaccctcagatgggggctcgcccactccggcgtgttatccaggaacaaatcgaagatcgcatcgctgatttctatttggaccacggcgacgttaagaacatggttgcaaaagttgaagacggcaagattgttttggcggctgagacgaagtccgaataagataattaaatttagagccagaagcgtaaacaatcgtttacacttctggctcttttttgtgcctacctcaaatcttcattgagtcgctatgaaatagcccgcgtctctgccataattaaacacctaatttaaagtcccataattgtcgttccaaattatcacgctcaatgccaatatagcgttttgtcacctgctcgctcgaatgattgaaaatcatcatcaatccggcaatgtcacgagtcttttgataataatgatagccaaatgtcttgcgcaacgtgtgcgtaccaatatcatcccgctccaggtactcaccggccgtctgaaagactcgatagacaccattaacggttaaagctccgccccgaccactacagaataacggttcatttgccccccgataccgcgtaaagtgggctaattccgttttgaggtttttcaaaaacaaccagcgcttcttgcccgttttttgttccatgatcataacacgatctttgccacgtacttgcccaaccttcagtcgtaaaatatcactcattcgtaatcccgtgttaattccaaccaaaacaatcatgcgattacgctccccataacgcgcttgtgaaacagcccataaaaaatcatcgatttcttggtccgttcttagcggttcaacattataatgcatacgctccattacacctcaatcaatcttattaagtttaaattacttaacctagagtaaactaaacaaagtaattgttaacctataatgctccccactattaagtgctaaaacaaaagcgcgggacaaagagtctcccctttatcccgcgttaaggatattacttcacttaatatccgtgaacgtgtacatctgcctataattgcaaagctgataattgatccgctaactgtgttgctggtgtcgtgtcaagtgatttagtcaattgtgcatcaacatccttcattcgatcctgaccagccttcgtaagcgttaagacccgtaaacgccggtcttgtttaattggttgacttttcaaccatccttgggttatcaaggtgccaatattttgtgccaacgaggctttcgccacattcaacgcatttgccacatcaccaatctggataccaggatgttgttcgacataaactaagatccgtaactcgttcaaactaagccctgtggcggacgaccagttcgacgtaagtcgttttaagtcccgttcaaggtgcatgatattcataatataattaattggttgttgcatactaacagcatccttcctgaaatttgtacttttttcattaaccgttcaaaacaagccattgtcccttcgcatgccccaagtaatatagatagcacacacattattataataacattaaaattagtatagtaaaaaggtctatccaattgagggtaggcttttttatggttactttgggcattatattgagagaatttgtacttgcggagtacaaacgaagtataacacccttagtcagcattaaacgttacacttttattaagatgagcaataaaaaaagtgagcaccccggtaagtgcccactaataaacttgttaaattcaacgaaataccatgagtcccgactaataaggataacttaatcttaactcattatcactaaattgcaataaaaagtgactaccttaaaaaggtagccgcttcccttataaatggcgcacggatcattataataaccttaaaattaacaaagtaaaaaggtctatccaaactggggtaggccttcttatggtgctcagtcactataagactgttaaatgattgaagggttactagtaacgcgactgagcacatatcgaagtaggcatacttaacgatgactgagactagcaaaacttgttaggagtgtttgcaactgccatagtcagttttcattatagcacaatttttagttagtttacataatgtccatcagaccacggaaacaccggtaattagcaatatgtatttagtcaaaactcaatttgttaagcgaaccctagttatgatttatagggttaagaaatttccgatgattttagtggcctacaacctgataacaagcgtaattaaaatatcgttaatcaaatgtttgatgaccttttgaggtagattaatgccccgtaacaacatggaagcaagcgcattgttatggggcatctttgttagtaacatgtagttttttcaacttgaagaattgcatgtgggtggcttaaagaaaaaagttagccttgatggtggaagattatacttgcaactcatcaaataaacacggttaactatactttttcaaaaggctttggaaacttttatcaataaaaggcattaccgtagcaatggaaagtttatcgtcagaaaaagttggtacaccatattgtgataataattctgccgctatttcttttccagcttccttttttaccagtaaatgtaccattatacacataacaactaccacatgatggatttttatcttttaaaaacgcagctactacatggtgttcttaaagtgaaaccctaaggttgaacactaaatccaatcttaggggggactatgactaaatttaatttagattttcgcataaaggtcattattgaatatttattcggtaagggttcacttcacaaaacttcgatatatcgaaattgttttccaattaatgatgcaaattagagtttgttagtatggtgccgaaacagatatactgcagtggctaaaagcaagacagacgcgccaacaaatacagatatacgggtatctgggtttataaacatgaagactacaataaccaacaacattgcaaatgcaaaataattcgagaatgggtagagtggtagcttaaatggatgacatgacagcaactgagggttgttcttccgaaaccgcaattcagctagtagaataacgaaccaaggaaccatacctggtaaaactgaggaactgaagacgactacgaacaagttggatgctgagctactgtaagttgatgcgagtgtatccacaataaatcctaataagattcctccagatatacccagaatggcggcatctggcacaactcgcttagacaatctacctagaattttgggtgcatcaccttcgtgagataatttaaataacattcgacttgatgagtagatacccgagttagcaccggataaggccgctgttaatactacaaaattgataactgatgcagctgcagtgatgccaatttttgaaaaagttgacacaaatggcgacccaatgttggccaactggttccacggatagattgtaatgattacaaagatagcgccaacatagaaaatcaaaatacgaaataaaacggatttaacggatttaataatagctatttgtggattagcaacttctcccgcggaaattcctagtagttcgataccctggtaggaaccgacaataatcgacattgaaaagaaaaatcccgatatgccgccggtaaagaaaccaccatgtgaccagagattactaattccaataggatggccgccgttgccccacccaaataatattaggccaagacccagtaaaatcatggcaataatcgttaatactttaatcattgcaaaccaaaactctaatgatccatatgccttggcgctaacaaggttcgcggcaaccaaaaatataatgatgatcactcccgatgtaagcgcgttaatgtggggccaccagtacttcaaatactcagttgcagcgacaacttccgacattccaacaataatatattcaaatacgtttgcccacttggctagataccctgctaacgggtgtacatattcagttgcataatcagcaaacgatcctgtcccagggtttacatagatcatctcacctaacgctcgcatgacaatataaagtatcagtccaacaaacatgtaggctagtaacaccgatggcccggtccacttaattgtcgaagtggaccccataaacaggccaaccccgatggctcctccaagagaaatcatttccatctgtcccgcggtcattgatcgttgtaattgaggtgtttcctttaattcttgcttcaaaatttcctccatagtaagtttgcaagggacgctttatggataaatccgttaatgtaagtatcttcttgcagagttaatttaaacgcaattagcatcatggtacgtaaacctgtttttaggcgaggaaaccatgattctccctaaacacgaactgagttcgtcttgttagaaatcagcaataagtaatgaacagtgactatgaaagcttgattttttatacatttaataactaggatctctatagtggctgctgttacagttaattaagctatgaaaaatccagtaattccaaccagtaaaatgtccgattgatggccccaaatagcttaaaatgaatgaaacaaaagtatgctgtgtaggatccgcataaaacatctcaccaatagcccgcatcataaagaagaaaaataaccctagtatcaagtaaactaacattactgacggccggttttgctaatcgtactacccagatccgagaaacagtccggtaccaattgttccaccaattgcaatcagttgaaagtttcacatgacgagtgtttaaagattacatgggttcatcttgattcttaaaaatcttttgatttcatataaagtttcccgaaatatgataaaaagattggcttttgattaggaactctcatattataccactgtttgtcatgtgtcactattcatgtcatgttttttgacatgttactcaatccaaccaccaataataatttaagcactcgttattaacaattcttagtactcaaattgaactcctttgaaccaacctaaattcagttggtaactactgggaaattagtctaaattaacgtattgtcagtgatccgtcaaaaacaattaatagtgattcaccgcattattttgcggcgactaccttaaacatatgggccatgatgggataatcagtgtatttcgcaccctggctgcagtgatggcaaatgcattttggggggcttgaaaaaattgagcacaattgcaaattttttcaaaaacgatagctgtatttccctttagtgtttaccttaaacgtatttagaaaagatattcaccaaagacacagacatctttccagacaagatgaaagccaattttaaaatgagtgaaagttaatatgaattcatattttcttattatccttgacacgggttcaattgcgccgcataatggttactattaaattcatatgagaaactaacgagaagatgagtaggacagccaccatcctgagagagttgccgtgtggtgtaaggcaacgttgggaactgtttgaagatggtcttttaaattgtctcagtgctgagctaaggctaggtgctggcgggaacgcccgttacagcgttagggtatgcacaagagtaagtactgattatggaaccaagcttaattttggtgtacccgtgaggaatggctcgtgagggtcatttaaactaaggtggtcacgcgaatagcattttcgtccttgtctagaaatagatatagatggaaatgcttttttattttggaaagggagtgtcccaaatgagtgaaaaaacagcacggtatgagttattaaaacaacaagcacgggcgttgttgacgagtgaatttgatttggttgccaatatgagtaaccttgcgtctctagtctttaacgtattaccgcaattgaatggaacttcattttacaggtttaaagataatgaattgatcttaggtccctttcaagggaaaccggcttgcatgcatattgcagttggtaagggtgtttgtggtacagttgctaaaacacagaaggcggaagttgtcccaaacgttcacgaattcagtggccacattgcctgcgacagtgcatccaaatcagaggtcgttgttcctgtgttcaaagacgggaagttctggggtgtctttgatttggatagccctgaatacaacacctttgatgatgtggatgcaaaatatctttcagaaatcgcgccaattgtctttggtgttcaagcagaagttgggggtcgatcttaaatgatagaagatatcagtaacgtcattgatctgaaagatattagggtgacatttaaaaatagcggcaaggatttggaggctgtcgatgatgtcaatctaaagattaaaaagggtgacatttatggcatcatcgggtattccggtgctgggaagagtaccctagtgcgggtgatcaacctgttacagcagccaagcgagggcaaggtcatcgttaacggccaggacttactagaattgaaaccagttaaattacgtgaagcccgacaaaaaatcggcatgattttccaacactttaacctgatgaaatcacgaacggtgttgggaaacgttgagtatccgctgttaggtaagaaaatcaacaagcaggaacggcaggaaaaggcactaaacttattgaaacgggttggtctggaaaaatacgctagcacctacccgcaacggttatctggtgggcagaaacaacgggtggcgattgccagagcgctggcaacggaaccagaagtactgatttctgatgaagccaccagcgcgttggatccgaagacgaccaaagctatcttggagttgttgaagaagctcaacgatgaattggggctgaccatcgtcttgattacccatgaaatgcaggttatcaagtccatttgtcataacgtggcggtgatggatgagggccgaattattgagcagggtaccgttgccaaggtcttcactgatccgcaagaaaaactaacaactgattttgtggaaacctctacgaacgtaagggcggccattgaccggataatggcaaccatcaacgttgcagacctgcctgacaaccaggaactggtatatttcaactttattggaaatgcgacgaaacaaagtattctctcagagttatcgcaaacctatcacgttgccgaaaatattctgtttgcaaacatcgaccagattgatggcgaaaatgttggttatatgattgctattatagagggcgagttaatacctttcaacaaagcacttgaggatttgcggccgcaaagggttaaaactcagattcttagtagcgtaccggcgaaggaggatgacgcgtaatgttacaaaaactgattccaaacgttctccagatgaagggtgaatttgttcaagctacttgggaaaccttgtatatgacctttggctcagccatcattgccgcggttctcgggctgctcctcggggtctgcttggtcattacgcaacccgggggaatccttgaggatggtttgacctattctgttttggataagattacgaaccttctacggtcaattccattcattattttgttggcggtgatttcaccgctgacccagttcctgattgggacaactgttggtacaacagcgtccctggtgccattgatagttggcatcttcccgttctacgctcgtcaggtacaaaacgcgttgttggctgttgagcacggcgtcatcgaagcagcacaggccatggggtcaagtcccacggaaattgtttttcgggtctatctccgggaagggctagcagacattcttcgagtgtccatcgtgactgttatcagcctcattggattgaccaccatggctggtgccattggttctggcggtctcggggacgttgccatcagtatcgggtacgcccggtttgaaaacgacgtcaccttcgtggctatgattatcattttaattttagtgtttgcggttcagatcattggagatctaatcgtcaaagccgtcgaacacaacgaatagtaggaaacaaactttgaaagaggatttagagtttaattagaggtggaaagtatgaagaaaagttttgggtggttaatcggcattattgtcgtgattgtaatagcaatttttgggattcatgccgcaacgagccacagtgctagttcgacgaagacaagcaccatcacggtcggctcacaggggtctgactacgacatttggcaacacatcgcaaagtcgaaggatgcaaagaatatgggcctgaaaatcaaggttaagcagattaccgatggggtccagctgaataaggcgactgctcaaggcaatgttgacgttaacgccttccagtcatggtcatactacctagcttataacaaggaaaataagtccagcaaactggccgctttaggaaccacttacctggaacccatgggcatttactccaagaagtacaagagtattaaagacattcccaacggtgcaacgattgcgattgccaacaacccatcacaagccgcacgtggtttgattttgttgcaaaaagccggtctaattactttggataaaagctttggttacttaggcactgtaagtgatatcaagtccaacccaaaacatctgaagtttaaggaaattgatgataccactggtccgcgggtcatcaacaacgttgacgccgtgctaatttcaaacacggttgctttggaaggacacctgcacgtgctgaccgattctattttccacgaaaaggttgatcaaagtacgaaggacaacatcaatatcttggctactgctgctaagaacaagaacaacaagtcatacaagaagttgattaagctctaccacaagaaagatatccaaaaatacatcaagcagaagtactacggtaccaagatcgaagttagcaagccgctgtcgtactttaacaactaggtcatttcaaattagttaaaacagttaaataaaggggagttcatcaattatggctaaagtagaaagtttcaccctggatcacacaaaggtaaaggcaccatacgttcgtttaattactgaagaacacggtgaaaagggcgacatcatcagcaactatgacctgcgtctcgttcaaccaaacgaaaacgctattccaacagccggtttgcacaccatagaacatttgcttgctggtctgttgcgtgatcgtcttgacggcgttatcgactgttcaccatttggttgccggactgggttccatttgattacttgggggcaacactcaaccacagaagtttccaaggctttaaaggcttctttagatgacatcgcaaacaagattacctgggacgatgttcaagggactgacaaatacagctgcgggaattacagggaccactcattgttctcagctcaggaatggtcaaaggatattttggctgaaggcatctctgacgatccattaaaccgtaacgttatctagttaaagaccatttaaggaggaatgagaaatgagtaaacttgcaatcattactggtgccggccaaggaattggtgaaggtatcgctcaccgtttagtaagggctggttacgctattgctgtggcggacatcaatgatgaagcggctacgaaagtggccgcggacttaattagtgagaactaccaggcgaaggcatatcatgttgatgtggcacaacgggatgaagtctttgcactcgttaacaacgcggtcgctgatctcggcgacttatccttgtatgttaacaacgctggaattgcatttattgacagctttgttgattcgaatccagatgacgttgagcggttattggacgttaacctcaagggaacatattggggcatccaagccgcagctacccagtttaagaaacaagccagcggtggccgcattgtgaacgcagcatcattagctgggtatgaagcctcagctttgcaaagtgcttattctgcttctaagtttggtattcgtggtctgacccagtccgcagctaaggagttggctaaagataagatcacggtcaatgcctacaatcccggaattgtccgcactaaaatgcgtgatgcaattgataagaaaacggcagcagtcaagcacgaaacgattgaaaagcagcaagctgattgtttggaagaaattgcacttggccgtgaagcaacaccagctgatgttgcagaagttgtggcatggtttgcatcagatgccgcagggtatattaccgggcagtcgcttcaggttgatggtgggatgagatttcattagctaggatatggggatatcctacgtaagggtagattgattttttggatgaaccatgggtaattctgtaatcgattgagcaacaaaggtttaaaagaattagaatgatattatcatgctaattcagcagcaaactaagatccagtttgagagtttagaaaccctgcaagctattcagaaacaggcataccagatgttaatgcaagggctgaccacaactgggtgctcaatgtgtgagggggatatcttgaacaacacggaaaagctactgctagtgaattagctgatgcgttcatggttacgcgcacactaatttccaggaacatctggcgactgattcaagataatttaatttaatcacaagtaaagtccactgatcgacgcattgtacggctaacattgactattaatggccaagcaacggtccaaaaaggcgttcggcaagtgcaagaaagcctaaaaaattccaaccaaagtcacaatttgaataagttggctaaacaagtggaaactttgtcacaacaactggctaaaataaattaaaagtttttcaaaataagtaaagatgccttaatgtaaataaagatcggtttgttaaaatccttgagttttggcaaaccgatcttttattggagtgatgtaaatttaaacattaaaattatttttttgctcgtgacaatgattattttgtatacccgagtaattaatcaaacactgcaagtggctaagcgttcccctgttaaaagggattagatagagtgaaatcaggccatgacttaacagttgtgatctgttttgcgatgtcctataatcaaggacatcttaggaacctgtataaatgtataaaattattctatcttactaacttaccactacattatttgaaggaaggcatagccttatgttcacattgttaatattgttgctacaacgcttaggcattattttggcattagcatttatattggttaatgttcgcttttttcgtagattgataaaccaaaaatcgttacgagcaaaatgggctatcattgcaatttttgccacttttactattatctcaaacttaactggtgttgaaattaatcgggatggtacgcttattcaaagcacctttttgacagcgctttcgccatcggactcaattgcaaatacccgtaccttgacaattacagttgccggtattattggcggcccatttgtaggtggcatggttggtatatttggtggcattcatcgggttatccaaggcaacctatcagattttttctatattccaagctcaattataataggcttgttctctggatttacaggtcgttatttcaaaaagaacattacttatgctagtccttggattacagccttacttggtatttgttcagaaggcattcaaatggtttttattggtgcgtttagtggcttagaattactaaagcttatttttattcccatgataggacttaatagtattggttcttttatttttgtctcaataattaatgcctacattactaatgaacaacaattaaaagccgttcaaactcatgatgttctaaacttaaccgacaaaacgcttccttattttcgtcaaggccttactatacactcggctgccaaagtgtgtgagattatcaaacgctatacgaattttgatgccgttgggataaccgataaaactaacgttcttgctcatgttggtgctggacatgatcaccatttagcgaatcaaactgtcatgactgatctctcaaagcatgtcattacaagtggcactgcacgtttggcttaccataaatcagagattggttgtccacaagtccattgtcctctagaatccgcaattgttttaccgctaaaagttaaccataggaccataggtgcactgaaaatgtactttgtaaaagctgatcggctcacttcagttgaagaaaatctagcgacgggtttggcatctatattttcaagccaactggccttgggaattgctgaagaacaatcaaaacttgccagtgatgccaaaataaaagctttacaagctcaaattaatcctcattttttctttaatgctatcaatacagttagtgctttaatgcgtaccgatgttgacaaggcacgtgcctccttactacaacttagtactttttttcgttctactcttcaaggagttcgtgaaaatgagattccattaaggttagagtgtgagcatgttaattcttatgtttccttagagcaaacacgttttcctaacaagtatgacattacttatgatgttagaactgatgatcaaattaaagttccgccattttgcttgcaagtgttagttgagaatgcaatcaaacatgcttttattgggtgcaaagagcataataagattatcatagtggttaaacaacagaagcaaatgctgaaaattacagttagtgataatggcattggtattaagcctagtctgattaagaaattaggacgtcaagttgtgccatcaagttctggtacaggaactgctttagctaacttgaatcaacgattaattggtctttatggtgaagagagtcgtttgaaaattgatagtgatgacactgggacaactattcaaatgtgtatcccatatcactaagccactcctaaagatgaggaagacagataatgaatgttttaatagttgatgatgaaccattatcacgtagtgaacttgaatatttgttacagcaaaataatagtgttatgactatctatcaggcttcaggacttacagatggactaaaactattagttacaaagcagatagatttactattccttgatattgatctgaacaacgaaaatggctttactttagctaatgaaattaatcagttagcaaaaccaccactggttgtttttgcaactgcttatgacaattatgctgttgatgcgtttaatatcaacgctattgattacgtattaaagccctttgaacaagtccgaattgatcaggctattgctaaggtggcttctgttttaagaggcaagcaagtcagtggtgacaaaccattatcttctttcatcactgtcactaaagaagaaaaaacacgtgtcattaagatcaatgatattgtctatgcggtcattaatcagggtgaattaactattacaactactcaaggaaagttcatcgcacatgagactttgaattggctaaaaagccatctggattcacaacgttttattcaagtgcatcgtaatgtactagttaatattgaaaagattcatgaaattcaaccatggtttaatcacacataccagataattatgatagataagcagaaattgccggttggtagatcgttcatcagagggcttcggcaacgactccagatgtgatctgtggcaggtaaatgtatttcagatagtgacaagggcctttggcacactattttttgtagttcacgttcaaaatagccttttttttgtctttttcgttatgataatcacgaagataaagaaaggatgattatcatgtccaacaagaaaaagccaactcccaaaagagcagctccattactggtacagtttggaatttatacagcgattctgtttgtctctaatggtatatcaagtttttttcctatcggtttccctgttccagcaccagtaattggtctaattttgctttacttactattaactttaaacatcgttaaattagaatggatttcatcagttggaacttttttaataagtattattggattcttgtttgttccatctggtatctcattagctgcaaacttaaaaatcatgcaacagcaagggtcaaaattaattcttgtcattatcttatcaaccatcattttattagtagttactacttatacagctaaattattgatttggggacatcgatggttgataaaaaagtaccatcaaccatcgttgaaaacagacttaacaacagtaatgaacttcgaatctaaggagcgtgattgacatggtttccttatttacgactcccttttttggcatttttctctctgtcatggtttatctcataggtcagtggctgtttaaaaaaagtcatggcttatttatatgccagcctctttttgtcgccatgatacttggcatcataattttgataatattggcaactatcttaggaactactacggaaaagatatatagtcatgcttacaagccgggtggtgatttaatcttctggttcttaagccccgcaacaattgcttttgcaattccactatacaaacgtaatgatgtaattaaaaaatattggcttgatattctagcttcgctattcataggtacagtcgtttctctgatggcaattgtcggaatttccaaactaatgggacttagtaccataggtattaagtccatgttgcctcaagcggcaacgacagcaattgcactaccaatttcaacatcaattggtggtaatagtgctgtaaccgccatggcttgtatcttaaacgctgttattatttatgcactaggcgattggctcgttaagatctttcacctgaattcggacccaattggtgtgggacttggattaggtaccgctggtcatacaattggttcagcttatgctctggaactaggatctattcaaggttctatggcggccatcgctgtcgttgtcattggtgttgtcgttgatctaattgtgcctttatttaacaaactattattttaggaaaatgagtcataaaaagcttctaaattgaaatgaacttcaaaggggtgatttagcgtccaacctttgggagttcagttcaatctactatttaactggcaactaagtcaaaccgactgtcgtagcaattaataaagcggaaactgttagccaaatagttaattttggtgttcaataaaagtgctaatctaaaagcttggcagaggtttatatattaattaacttaagaatcgattatgaaactccgtattgctaaaaaatattaataatccaaaatttcatacgaactgtaagcaatgtttaaaattaattaaacaaagagttttactcgctgacgtcaccttatgttctggttaaacataactgggtttatttagcaagcgtttataatccgagcaaccatttggacatggcggttatttaaggatcacatggttccggcctgattgttaacaatttttgatttcatatagagcctcccaaaatattaaaaaagattggtccatgattagaattcctcatagttaaactctatattcatgtgctgacaatacaaaagacgagactgagggttgtcatttgattcttaatttattgttttaagttaaaaattttaacattagtaactaaatagtgaaggcctatatacaattactgaactagttttgcaatgtttacttgcatgtaattcaatttaaagtttaagtgtgttattataaatgtggtttattaagaccacttaattagtgatggtaatgtggcacgtgctacttagaataattattgaaaactgtttataggagactatttaatgaatttatcagaaataatatttaaagggtatgttcccattgttttatcgtggttatttcctatcttaatgctattttttgccgctttttttgagcctaatattcaaatgggtatttttcttttattactattatctattatagtgggtatgttaatacctgggattgttatcagttggctaattattggattaaccactgttggagcaggtatgcttttatttggctatctggttattccagttaatgacaaggtcatattattgttagcatttccaattgaagcgatgttagtcaatctagtcagcaattggctactgaagtggcgatcattaggtcctaatatagcttcaatacatcgctatagagaacactataacttagacacaaaattattgaccagccataatgctgaaaaggtatattccaaggaaattacagctattaaaagttatccggcatataatctcttcatgaatattactgaaattcattggcaaaattggcaacagtatcgacaatttcatcctgataatcagcgaaaagttttacacgatatcgccagagaaataaagcatacacgattaccatcagaacttatttattacttaggtgatgctcgattcttaatcatttcatatcgggttgacgaaaacacgcaaaaaacaattaatgatacaacccaaaaaagtctacaacaagcatttaaaacgccagctattcagttcaaatgggctacgcaacaaattaaatataataactacgatcaattcatctactttgctgatatttgcaaacagcttgatcgtgtgatggaaacagatgttattactgaatattcaagggaggggaactagttggtttcatttttctttgatttaaccatattcattacgggaattttcacaattagttttttggtcatatttatttgtgcttggacaatttattatcgagttgaaacaagttttttggctaccaataaaaaggagataaaaaagtgattagtgaggtattgaccatcctaacattaacatctatttggatatcgctactcatgggtcttttgacattaagtggggcagtatctttctggttgccaaagagtcgtcaaaaaataacagtgggttcactaccgtattatccattaattaccttggtcgtaccagcgcacaacgaagagcttgtcattaaacaaacaattagcgctattctgaatttgaattatccccataacaaactcgaaatacttttatatgcagataattgtacagatgaaacggcagagatgatgcgaaaaacagttttagaggaaagtgtacatgatcaaaagataagggttgttgagcgtagtgggaatggtggtaaagcaggtgtgcttaatgatgctttaaagattgcaactggtaaatatatcggtgtctatgatgctgatgcggtaccagagaaaaatgcactgtattttctagttaaaaagatattagaaaagcccaatcgttataaagcagcttttggccgtaacaagacccgaaatgcacaacataattttttaacaaaatgtatcaatcaagaaattgttgtgacccaaagaatacaacatgtgggaatttggcagctgtttagaattggaagaattccaggaaccaattttatcattgagactgattatgttaaaaaaattggtggctggacaaacggagctttgacggaagacacggatatttcatttaagataatgcaagagggaatgttaattgcactggcttatagttctgaagcattccaacaggaacctgagcgtattaaagactattattttcaacgattacgttgggctaaaggtaattaccaagttgttatggctaatttcaaacatttatttgacaaaagtaactggcgtgtgaaattagaagttttttattactcctgtacctttttttggtttaatgcagcaattgttctatctgatgcttttttgatttctaatttggtggcactgttaattcaactatggcgaccggagactgcgattccttttgacttttacagtagtaacattatgataactcagctgttgttatttaactggttattaatgatattattatacgtattgcagattaatactgctatggcaacacaatatggtcaggctacaactgaacaaatttggttaagcctcatttcttattttacttattcacaattgtttatcgtgatttctatacatgccattatctctgttttattggacactgtatttcatagagatggtagtaagtggattaagactaagcgttttatggactaggagggctattttgaaattaacatggcgattatggggcttagttttaattgtagtgacaatatatattggtattatcgggtatgtccggttggataacacccaacaacttagaaaagaattttataaaacatggaaaaatgattatgtagttgctatcaatcaaaaacaatcgttgattaacacgtcagatactggtcacaaagttagtgcattatctgaagcgcaaggttacggaatgttaattagtgtccaatcatctaagcttggtttagagggaactcatacgtttaatactctgtatcaatattatatgcatcatcgtatcaaaggtactcagttaatggcctggcgacaaagcagaaatcagtatggaaaatggtctagtgaacagactagtgctactgatggcgatctaatgattgcccaatcgctatttctagcatctaaaaaatggccacaaaaaaagtgttatgctaaccaactgcacctgcttttaaatgacattttaaagtatgaaacaaaccaacatactcaggtgttaacagttggtaactgggcaactcctgcgtctaattcagccaatttaatgcgtagttctgatgtaatgcccacggcatttgaacaattttataatttttcacacaatcgtcaatggttagttattaaaaatacgatgcttaaccacctgtttcaattaagcaaacagcacaaatcaggcttagttcctgatttttcatgggtaactcaacataatacaatccttgtaaaaggtacacatatcaccaataaatacgccaatgattactactataatgcctgtagagttcctatgctgttagctcaaagtcatgacccattagcacaaaaaacattgaagtcaatattgcgtttttttgccaagcattctactgtcacagcaggatatactatgagtggcaaaccactcaatgactatcagtccgcaagttttagtgctcctttgctaatggcgaccagttggcatcgcaatcaagggtacgattcattattttttcatgaacagtggatttttgctaaagcaatgactaagcacgattattataatgctaccttgaccatgtatgcgcttatgttttcgagcatttaattctttttatctgacaattatatagttgagttgtctgtattcactttactattgtcttttagtgaattcaaactgaatattagttaattaattatcaagatagttggtagaaggagggaataggccctgaaatatttataatgtttctctttaattacaatataaaaagcgactgccaaaaaagatagtactctacagttaaccccctaagttgaggtaatcccaactcagggggttactatgttaccgtatgaaattggataagaaatattatctgactttgcacgagttgttcctatctcaaaatgaacttttacacgtttggtttatgagaatttgaaaggtaatgcctcaattaaatatactacaattatttctccaaaccactaattcgtttagtgagtttgaagttttaattgtaactatatacttcctgtatataaaatataagtgcaacacataaaacgctagaccaaaaagatatgaaagcctattcttaaatcgccacaagataagaaagggatatcttcacgatcaataaccagaataccattgatcgttgctacaacaatttcactcttacgtacgtggcctgactatggcatcccgctagtttcaatcttagtaccattaatcgtgtgacaattctgtaaattgagactaatcataatcttttttatggcctaccacaaatagtttatgataactgttttgctgcctgtcacgctgccagctggttgctaaaaacgtggagtcaatgataatcaaaactagctgattcgtgagttaatttcaaaagttagtccattaagttcttaaccatcactaggattaaaaatattaaagatccttagaaccgatgctctgacgaatatttatttatcaatcagtcatgggcgttctgcagactttgaataaccagaacactatttaagaataggtcgttggtgttgcgcttgatttgaaaattcgaggattttttctctgattttgaattcaatcttaattcgataaattagatattatcagttcttacaaccatttagggagtattttattttgtaatcttccatagttatcaatctgaattttaatattttacattataatcattttgccaaaaaagcctacatagtgtgtttgttggaatacaaaaaactatatgttgtgttttgcgctttaaaatttcgcccaactctgctaatatatttaattaaataggatagttaatggggttggtcaaaatgcagtcaaatattactcatagaaacaaagagtcttcgcaaattctatcatcaaaaaagaaaccgcgtgttaaatatcattggttaaagatttggggaccaggattaatagtcatgttggcagatactgatgcaggttgcttaattaccgcagcacaatcaggaacaaagtgggggtacacgatgctcttgccacaattgttgttaattccaattctctatatggcccaagagatgacggttcgtttgggaattgttacccgaaaagggcatggcgaattaattcgtgaaaattttggaactggttgggcatggctttcagccgtcacattggcagtttctgcaattggggctttgctcactgaatttgtgggagttgcaggagtaggtgaactttttggaatgtctaaatggattacagttccaatagcaacactcctgttagttgggatcgccttttgtggcagttatcggcgtgttgagaaaattggggttacaattggcttagctgagttagcatttgttattgccgtgataatgatccgacccaatatcactcaaatggcccgaggattagtgaccattccatggagacattcttcctacatatatttactagctgccaatgtcggggctgtaattatgccttggatgattttttaccagcagggggcagtggtcgacaaaaaattgagcaccaccgaaattccacaggagcggcgtgatactttggtagggacttttattacacagggaattatgttaatttttgtgatcgcttttgcagcaacgattggtaataaaacaaatgttacatctttaaatactgttggagatttggccaatgcattagcccctttcattggaggaacagctgctaacttactgattggtgctagtattttaggcggtgctttggtggctgctttagtagttgctctagcaggtacttggggaattactgaggtcttaaattggaaacatagtttgaatgaacccttaaatcgaacgaatattggtttttataccatgtatactttagcacatgtaattggagcaattttggttctagctaattttgatttagtcaatattgcaattggagttgaagttatgaacgctcttttattgccaattgttctgggattcctacttgcattagaggctaaagtattacctgaacagtatcaaatgcatggcatgtacaagtggattgtaacacttctttgccttcttgttatggcatttggtgtctatatggtaggaccaacgcttggcatttggtaaagcataaaccaatttaataccatttaggaagacaaatatagtctatgatattttgttaaaaacaagattttagaaatgattaattacagggttgcgtcgaaatagtctaggaatcgtctatggcagtgcgttgatgatgacaataataatagattttaatctactaatttttaccctcacattctacaattggttattagacatattcatgacttgccactgcttgtgtggaataatactagatcacaatgtgcaatagataatttgattttctaaaaaaagcaggtctgaaaaatcctaagaacttttcaaacctgctttcaatatactctaaaactataactacccgtataacggtagattattttagaaatataagtactagtatttccatctttgtggccgtcttaagtggcattggtattacgtaccttgactcttaaagaaatctccatattctcggacgctcaattggtattgttcttggtaacggctatatttcttgataatggtttcgttaaagataggcctaaaattatatcatcatatctcaatgagaaagttgaattgtcagactctgttgagaagattcagcaatacatactgcagatgaaaaaactaaaggttttcaacttaaattttttgttttagggagataaagtaacttaaaaaattgagacgatagggtgtaccctaatgtctcttttttgagctgtggtataatagattaaatgtgtgagacattagagtgtgacacagtaacctttaaatcttaatcagatcaactaattgagtagttgcccagaaactgatgtcagaattaatatgagaagaaggcaaatatatgaaaattggttatgctagggtgtcgtctgaaaatcagaatttagctcggcagattgaagctctaaaaaagtctggtgtagagaaaatatttcaggaaaaagtttccggaaaatcagttcaaaatcgcccggaattgcaaaaaatgttagagttcattcgtgaaaaagatattgtaactgttttggatttagatcgacttggaagaaatgctcaggacattactgacaccattaacttgattcaacaaaaggcagccacactagatgttttaagtttaccgagtttcactgatatacaagatgttaacttacgtggtttattaaccaatttggtttttgaaatatacaaatatacagctgaagaagagcgcaacaaaattcatgctaggcagaatcagggaatccaattagctaaggagcgcggggagtataaaggaagaaggcggcaatatagtccagatggatcaaaacgcttcctatataagggggtagttcaaatgctcagggatggaacgaatattgcacaaattgcaaggagtactggcgtacaacgacgacaaatttatcgcattaaagaatatgctttaaaagttggagacttaggcactcccaaaagggaagtgaatggctagggcctacaggacaaggtagtgttttttagggaccaccggtcaaataataaagcgcttacattgataaaacattttggagatgaactatgttttttaaagattggacaaaatacaatagtttcgaattagttatgattacgttgggatgtagcatttatgcgtttagtctagatttaatctctattccaaatggtttagcagacggcggtctgagcggaataactctgattattcgtcatttctttcatattaacttgggtattagtactttatttctgaatattccattgatactaattggtttgcgctacttaggcaagcgcatgatggcttacactatttatggcaccatttgtttatcactatttctaataatatggtcacagcaggccctgattcaaccactaccattgagaaatgatttattattgtcatcactggttgcaggggtattatcagggttgggaattggtctggtttttcgttataacggaactactggtggtagtgatattatcgctcgggttggccagagaagttttggattttcttcgggaaaaggaattttgattattgactacgtagtattagggctgtcactatcatacttagatctgtatcacatcgcgtactcgctaattgttagtttcatattatctaaagtaattgatatggtccaagaagggcccaatcgtgctaaggtattattcattgtgtcagataaaagacaaaaaatttcccaattaattgatgtttctttaaatagaggattgacatatttgcaagctgaaggtggttatcagcatgatcaaaagcaagtgatttatttggtggttcaaccgcgggaaattccacaattgaagcaattaattaaagcgattgatgaacgggcatttgtgacggtactggatgcccatgaagtgattggagagggctttagttatcaacgcaaaagataccatgttaattggcagcacagtaaagaataaaaattaatagacgttttaatatgaaaaaacggctataatctactagtcacggattagaaaattgttgttttgatcacatagagcagttgggagctcatatattgaacaataatatatgtgaaaacggccaggattcaaattttatagttttactattgagacagccttgaaaccaataggtgtattttttacaagccttaagttttgacaagtatcaagtaactattttttgaaataatgcggggaaaattatgaaacgaaatattcagtctatcggaaatactatgctcagtattatcagtagtacagttgttgtattaccatttatgatttttttgaaatggggaagtagtcatactgttgttgcagttttgccatttgtcatcttttacacgtttagaacaaccggaattttttttattcgtggcataagaactcagataaatagctatatactactaaaaatagctatctattgtggccttttaggttcattatttggtttagttggggtgtcatttttggaattagagcttgtttcagggttatttctcgggttgagtgcggcttggctaccaatggctaacaatactattaattattataaacttgaaaatcatttaactgactcaaaaaatatggggattacagtactgtctttaacttttcttgggattgtgttgctgttaccaaataactatagttttgtgcttttctttgtgatttatgggcttatgtattctctggctttgtcatcactaattaacattaaaaattatgaagtccaagtccatgatttagaggactattcttatcgatatttaatcctatttctatttttatttgccttagtgttccttctaaggtctagtcgtctactattaagtacccttcaattcgattactttgtgtatggaacatttttgttagtactgtgtatgttgatattgagtatgttttcgcatcatagacctcaaagacgagttcccagtgatctgagctatttgacgatacttaatggggcacttggtaattatctctttttatttagttcattatatgcagcgggctactatggtcataatcaactattcgcaagattttacttgccatacgttttaggtatagtgatagcacctataataggtggtttagttgaaaaaaaaagcaaaaaaatttctttaattggaatgacagttggactgatattagtattaatcacgccattttttacaagtagtgttttaatattaagcacttttaagagtgtttttaatggctggttgactgaaatatataggcatcaagatgagttaccaaaggataaacgtatctgggttaagtacactattcaaagtatgggaagtatcgcccatcagtttgttttaatgataataggttctttacttgttatgggcaatcaatcatcagttaaaaccttttttgttatgactagtcagaaaattcctacggtcgaaagcagaactttgatgaccaactggaatggcattgcaacaggaatcctgttgattgggttgattgtctatggactaggttcagcaatcaaaataaacgtaaaatgatgtcatttttgcagcgatccacaaaaatttgagtgaatttttaattgggcactagcattcaatgggttggggcgacttgattgtagcacagatagtatgtccttttgctatacataaaaatggtgtcgatggattttgtccattgacaccaaaatatcataaaccccataaaaattacttttctgtagttctaattatcttataaagttgctgatactgactaagcatccaagttttataagtttttccggacggtaaagtttcagtaacagccagaactggaacattattttttcttgctaaacttactaaattgttaacagtttttgaatccacttgtttgttaaaaacaaagaacgcaattttgtgattcttaatatttgtttgcattgttttaatagtctttggagatggatcaacaccattttcagtatcttcctcaaaactatgatctgctactttaaaaccggcggcctgtaaagcgtaatcaaataccggttcactaacgtaaacctctttattggtagtcttctgagcgactgcattgattcgtttaatttgttgattaatcgaagctaaagacttaatatattgcttggcattggctttaaagtaagcttcgtttttaggttgtaatttactgaaatgtttagccaagtcgttagctagtttaggcattgtttttgggttataccacaaatgcggattatctccatcctttttatctaaaagatcttcaccaactttaatatatgtagccttaggggcatttttagccaacttgctcatccagccatcataacccactccgtttgcaaccaatacattggagttagccacttctttagctattttggaggttggctcataatcatgtggatcaacactaggattattaatcacagacgttacatgtcccttgttgccgacaactgccttagcgacttccccataaaaatcagttgttgctgttactgttattttattatttttagtggatgaagtagattgtgagcacccagctataaacgtcgcggtcccaataaaagtaataatcaatgttaaaagctttaatgtttttttcaaaattatttactcctcaaacaataatatatttaatggttgaaataccattttacctaatgcacgtactgtgtaattcctcttactacatcacgggcaactaatctttgatatattttagattttatgtgtttaaaatcatgtgtgctatccataaatcccatttcaattagtactgccggtcttggattatcgcgtaacacttcaaaatcgccaaaagctattccacgattaactaacggaagattaacaaaattattgttaagtttctgagcaagcttacgagcattctgatggtattgaaacacttcaaacccttgggcagcatttttctttcccgcagaattaaaatgaaaactaataaacaacgttgccttatccatattagctattttaggccgtttagacaatgataccgattgatctgattgacgagttagtataacccgtgaatattttgaccttaataactgggctactgccaaggcggttggcaaggtgtatgttttttccatggcgccatgcaacccaatggtaccggaatcaatcccaccatgccctggatcaagaacgattgttgcttctgccaatgaattgatagctcgatacttagtttgatgaatcaaccagcttgcaacccagccttgatgatggccaactttaacacgccaccatttagtatgaacgttctttttttctacctttaatctggttccgtaagcgagcttttcgataatgtgaccctttggtgtcggcatgtcacgcaaattaattgtttgtgcagtgactttaggctcacagaaatattgaatagttagatgtcccacgatatatacgagaccaacaataatgatgacacgtaatataaacaatggctgcttccagaatggtattttgttattaatcaatgtgctcaaatccttaatcatttaatgtgatttaagcatagtgattaacagtctctttgtaaagtacggcagaggctctaattagtctgcccggttaaacagccgtctctgttttttaatcactttaattgttttcaacgcacgttttcttgtctttatattgggactttttagatgtctgcaagcactcgaatggtcttccttttccatgatagttatcctcactacaaaattttataattaccaactggccttgtgtatcccagaaatttgtcccagtaaggcatatttgcggaaatttaatcgggacattccaaacttacgcatatacccacgaggccgcccatctaaaacatctcgatttcgtaatcggattggattagaatccttgggcaacttagccagtgccacgtaatctccctgtgcttttaaatttttccgttcaccagcatacttcgcaactaacttcttctgacgctcatatctagctatttttgacttcttagccattagaattttcccccttgtgccctaattaatctcagtgaaccaaactctgtgttttaactttggcgagtatttttttaatttgatcttatgaggtgtattcttaggattcttacttgtcaaatacagtttttcctttgtgtccgcattagctaaaataattgttttccgcatttttgcaccttccttattgggtttaaaaagaacaagcacctagcagactatccatagcatcttcatcaactgatgaaatcacaaattttacttgtcgcgccattgaaaaatctataatttgtccttgatgatctaaaaagagcaaatcgtattctgccttaatcattcctagaatagcgactattagccaggtactattacttaagggtgattgaaccgtcaagtaattattagaattactaaacttaagattagcttttggacaatcataataattaaaagcacactggaaacattgttttattagctgatctgagaattccatgctaagactcctattgctcttcatcatcacttgagcgatttatgaattacctgttttccgtgataataacccgataatgagacatgatgtgaaagtacatattcttgaagttggttatcccaatgaatagccggcaacattaacttttgtgtagctcttcgtttcctctttcgagatttggactgacggcgtgcaggtgtagccataaaatcatttccttccactctaaatagtaatcgctacgatttagcatacgatattgcgtttgctatgtcaatataaaaatatccttgacaaagcataggcaatgtagcagactacaaaaagcaattattacgatttacaatcgatttttacttttccctttgcttagagaacccccgctttaagtaatcccattctagggactactcctaaagttcatgcggaagtcacttaactttaggagttttattatggaaataatttcaaatacaacaatattgaaaacattactaggtagattaaaaattcgatccgattttttacaaattggttagcgtaacctgataaggtgcttgctagtggggactttagatggtttttggttaatccggagtaacatagttgttaaatcttgatcacaaatgtgaccagaacgagtcccttaggttaaaaaatacagtgtttgacttatctattgataattaatattaatatacttgacataggatctatatggataatcaatgtttgatgacattctgaaataaataagcggctataccaacgattatctccatgttagtatgagccgcttattaatagtttggggtggagtgttcatgttaagaacaagttgtattatatcatggttaaaacatgtttcaaccacttaaaaatgagcacttacttgagtgctcaccaagaagttctcacttcgaaacgaaacatcatgagtccttaataagtaggacaacttcattctagctcattctcattaaattgcaataaaaaaagcaactacctaaacagatagccgctccccaagtaatatagatagcacacattattataataacattaaaattgacataataaaaaggtctatccagttaagaacaggccttcttactatactttataaaatcaatctgcgccaactcagatcaattacacccggttcaaaatgaaagtagtgcgccatgtcaacagcacacaagtagtatatcattatcaaaacatgttgcaaccactaaaaaagtgaacacccgggtaagtgttcactaagaagttgtcactttaaaatggaatttcatgagtcctgaataagtcggacaactttattttaactaaatctaactaaattgcaacttaaaaaagcgactatctaagcagatagccgctcccccaagtagtatagatagcacacaaattattataataacattaaaattgacgtaataaaaatagcctatcaaattaatgacgggctatcattgattggcacagaacgcaccgaggtaagtataacataaactagtttacataatccccattaatcaaagtccccccactaacaccatgttagcggggggacttattctttaccttgtgaattcaaattggtctaggtgaaacaataagatgaaagccaaatttagcagcattcttattttggaaaagttagtgaatcctagccaatggtggaacctgataacgactaactctcttataattggtcacaccaaagttagaattatatgtaattctaatgatctgccccttatgaaatgggcctaaatcatcagcaacagtttgaaactctaaccgttgtcgattcccatatttatctttagcaacaccacgatacacataaccattctgtgtaatcccaactggaactgttacaggaaacgaaccactactaccattagttttcatatagtagtaatcaccaccataccgataaatatgccacccaatacttaaaaccgtaaccccaactagtaaaacgcccaagacaatttctatccaatgatctttgattgcaaacttactcaaaaatagctccccctaatcccccaaaaaatctataaaaatatttaaaactaacttgactttgctttcaccctttgctgttcagagcgcttgaacctgagcgggatatagttttccccttgttttgcgaagaagaaaactttttgttgttcgtcacgaatcaccgtcacgtaaaaacacttgtattgttactattgcgcttgtagattagcctaactaatttagcctataaaaaaagcaccctttataggtgccagcaatcatttatttttagttgtttggatcactggccttgcgtaatcgccctgtactttcgtactgctttaccgcccgccccgtgcgtggggccaccgttcggaaccaacctaaatacaagtataggttaattcctagtgggagtttatagcggcggctctcacttgacctgtcgacttgtttcattagcttgttaaccggctgtcagtcctcgaaaggtagaattaacttgcttggctagaatgttgccactctagtaacggggcttggctcccccgtgatccagaaaaattcaactctacctacttgaaaaatcttacaatagtaggtaaaatgaacacataaccttgaatgagttacgtgttcccccggaataggccccgagggaatttttttgtctatttaatttagttacaaacagtattatacccctttgccgataatatgacaaaggggtatttctatcgtcttagccagccgaataagccctttttaggcgtcttagtttcttcccccttgtaattaccctcggtaggctctgaaacgtctgtatggtcgtttgaggagccctcactggccttttgtggggtatcgagtagtttctcgttttggcggttagtggataagtttaattgttgttgctggcttagtaattgctgaaacttgtctatctgattatttttagccttaatctctgctttagcgtcttctaagtctgcacgtagttgcttcactagatcgctctcattgtcggtcttaggactacttgaactattataatagctttctatagcctctacagattctttagtgaaattatacttgcccttagcatctttcttaggttgcttatcagctggtatttctttgattatctgataaatacgaccgtttgtgacatttaatcgtttagcaatacttgatatagtctccattagcattacactcctatactcaacaattataagcctatatctaactaaataatcatagtaaaaggctatgtatagtatattatagtgaactatgcactaaagcaagtcaacgagggcttagaatacgtctctcaacatataatataattctatcgtggagagttttaagggtagtggctgtttttgcttgaaaggtggtggtgctgcacccatactaggaaaggttttcagccatgttagcttggtgctggtttggtctagcagtcgcaagacttgcttaccaaatttatcgagacaacaaaaccaaacaaaaaatactaagcttagtattttttgtttgtcacctaaatttgagctttttccaacttttaaccagaatcgttttaatcactcatccatttgaacaatagccagtcctagtttacaacaggtttcgattttacttcgtttagaataggttatactagacaaaaaatcagctcctaaaaaatgggcttgtgataaacaccattttaaaggaagctgatattttcccgaacagcgttcggattagttttacaatctaccttaatcaattactactttcattccatatggaatattatcatagacccactttgagtctgcaatacttaaatgtatgcagccatgcgatgtaggctttttacctaaattttccgcaatcgacttaatataatgctgctgtgaatcaaccggtgtagaatgaaataagaattctccatgattaagccatgatacccaataataggccccttcattttcgctctcactgtagaaatatttacctctttctgcttgaacatggtaagttcctctgggggtctcgtgtgctttatcgtgaattcccgttgatatatacattgtgtagagcactttatgctgagtcattaagtacattctttgcttttcaagagatacatgaatccacatatctggatattttttcacctctggataagggataatttcagaggatttatgccaattaattggagtcctcataacttttggcttagtcttcaaagctttcgacttagatttttcaactttggtaacattagcattaacatgttcagaagtatgtgtcctgtttattccataaactaaaattagcccaattgctactaccgtagcacataaaacatatacactttttttcttcaaaaatattcaccctaattaaccacagctacatatcgggttgcacctgaggcccctacatacttcaaccaagtatatccatctgcgaccaccttaccaatataatgcaccgtatctcctgcattatattgtccaacaatagacgcacttgtacttggtgcagttctgatgttagttgctgttttaaaggtataatttccggattcattagttgtggaaccactacttgaagcattaaccacagctacatatcgggttgcgcctgaggcccctacatacttcaaccaagtatatccatctgcaaccaccttaccaatataatgcaccgtatctcctgcattatattgtccaacaatagacgcacttgtacttggtgcagttctgatattagttgctgtcttaaaagtataatttccggattcattagttgtggaaccactgttacccgatccactaccagattgccccgagtcccaagaatttaaattataatcttctatgcaattaataagtgtttgtgcgtaggtaggagccgtagcatacccatcgctttgtaaatatttagctactgtcttgtaatttgttacacctaataaatttttataacgggaatttcctgctaaaaaagctccatgatcttcaacactggcagaccaattaggatattttctaaaagcagcattaattgtaatatagcttccattcacatactcttgagtaggaaaataaatagattgtccattataagaacctttgataccaaataagttttttcctcgtacagcaagatctgatctcccccagccactctctattattgcttgtgcggcagacaccgaaggtaaaaccttatattttttccaaccagatatagctccacttttaatgctattcataaaggacgtttgatagccagcaagtgcaaatttagagctataactaaatgatctgtatggcgcagtaataacctttgactcagcatagtaaccggggccaatactaggattacgttttaacacaacagtttgagaactatgatcatcatttttgcttggattctctgattttttatttgtagattgatctactactttaacagcagtagacttatttacagccatggctttagcacgaatctgatttgctgtaatggaaaataaactagtacataccgacaaggccaagatagaattacagattttcgttgttactacttcccatctatttttttatgtttacagtgtaaatatagtacaaatattcacatatcacaaatttttctccagaataagaagctgttcagacggttctgtgcaaagttgaaacaagagaatcaatgtaaaaaattgaaaatgaattcttaaaaaaactcgataccttagcacggaagaagtcaaaacacacgaactcatcaaactagtagacgagttaaggcaggagtttcaagtttccatcaaactagttcttaaagcggttcatattcctcgtagtacgtaatattacgctaaggaacatcgtggtcgcgatttagatattcacaaatcattcaggccattgatgagattcgtcaacaagatccgaagtacacccgtaaatatggataccgacgaataactgatgttttacatgattacggctttaaaatcaatcacaagtggggcttacgtatcacgcgggagcatgactggttatgtcgagcttttaatcaccagaagttaaaatataattcttacaaagggaccgttggggcgattgcacctaatcgacttaaacgacgcttcaaaacatcggcgaccttaccagaagctggtcgccgatgttagtgaattccgatacagaaacaagagtcaagacgagcgggtctatttagaaccaattttagagctcttcaacaaataagttttaactttcaatatatgccgcaattacattactaatcaataaacgaaaaaaataacgcactttaggatctataacttataaataggcctttgatcatttctaaagccattcttcagaacgttattacaatctgaaggatggctttattggcgacattaaccaaactatccagttgtgcaagtaacatttgcgtgactaatgctagtaattcttgctaggattgccttagatccttgattatgatttaggaggagtgagatttgagctttaaagacgatataaagaccttgcgcaggcaatctaacttaacccaagaagcgttagctcaaaaattacatgtgacccgtcaaacggtctcaacttgggaaactggcaagaatatgccaagtttagagaccctgcatgctttgagtcaattgtttaacatctcactcgaaaaacttctatttaacgaggagattgcaatgaaaaaagataaagaaccctctttggctacccagatagatcatgatgttaagcttaaaagtcgttatcgtcgttggacttttggtttaggtggcttgatcgtactagcactggttagtattggtattttatgttggggatattataaaggtattgggacgattgatcgctttgatccgtttttatcctataaagtcgggtacactaaattacctagtgaaaaggaaatttctcctaacaataaggcgaccaatggttactggaccgcttggttcaccgataatacgatgggtaatgaatggaccaaattaactttaacgacggggcttaatcctggggtcaaagatccttatgtgatggcgtatcataagggcagctatgttaaagttgcacgtattgtgcctcgcacctacattaatcagacttatgttagcaatttagcagcgctagatgccttgttaaacaataaaggcaatacagcaactaacaatcatgaccttaagaagtataagacacaaatccatatatccgatactgtccagcaattagtcactgaataagccgacgtttaagcgatttaaattgataatctagccattaaaaacaattgtcacaattcaaaacgcttatattatcagaaatctatcaggttagccaaggctactctgatagatttcttgcgttaaaatggggctataccaacgatgccagaataactggcttgttaatttagactaatcagcttaaattttaggagggatatgtatggatattaagcgtctacccaaacttttaaagcaaagaagacagttaagtggccttactcaagctgaggtggctaataaactacatgtttcacggcaagctatttctaattgggaaactggtcggcatctgccagatctgatattagttaatcaactggctaacatttatgatagctctgtagatgaactgattaatgacgatagcaaagctaagcttagcaaaagctcggtaagttatatttatccactactgatgctgtcaatattagcgactagtcggctaacacttgcttcaagttcaaaaagcctattaatcatggacggactgattttgttaagcgtgatcttgctttgcctaaccaaaatcaaaaatcttaaggtacagctttcactacaactaatcacgcttataattttccttggttgtacctttaaaaccagtcttttaaacagctttggatttcaaacagccgcctttctgaccagtataattctattatgccaattagttagtacatatcactaccaaaagagggagtaacctaaaacacatgaaattaaaagtttggtggctaagcaatcttatttggctaatcatcttcagtatattaagctttgtaatttttattagaaaagttgatggagctggaacaattcaaacgccagcaactaaattagctgctttcattgtgctagtgattttctttatttttatcgtcttgatccaacttgtcttactgttatttgttaagcgtagaaagtaaaactcaaccatagggtctataattcacaaataacccctcaaaaacattgaaagaataacccccaatatctataatgtagattttgggggctatttttttttatatggtataaatgacttcttttattcgtcattttttcgataccttttggaacgattttgaccaggaaataaacgatcatgcgatcctactcgaattccaattaagactagttcatctgtatcaatcgtataaacaaccaggacatcgttagtttcgcttggtgttttgtttttcggggtgtctcgtaaatgaaattcattatagccgctcattcgccgattaagctcatgatcttcaaattctggtggtaattgttgttgctcaagcaacaggtcaatggctgctcgaacttcgtcaataatagttttatctaaactggctaatcgctttaggtcagcattaaaggttgaacgcggtttaaatcttagttttttcattgtttaaactgaccccaataatcatcatttgattcaacaatttcatcatcaggtaaaacatgacgtttaattaactgatcacgtgcaattgcatattctaacgaaccttctttagcttttaatgctctttctaaccagtccattttttcttgcgaaacgatggccactgcgcgactatttgaacgagcaatataaactgtttcgtcttcgtcattaacttgatccaaatatttttttaagttagcgcgaaaatcgctctgtgttaatgctaatgtcatatttaccaccctttcattgtacttaatattgtactttaatttgtactaaaaatcaattttttaaaggggctaaaactatgcaacaaatcgtcttaccaatcaaagattcaaacgtcctgaccgaagtacaagataccttactacacaattttagagctggtcgtcgtaactacacgatttttcaggttggcaaagccaccttgttacgggtaagtgatgttatgcgccttcgttggaccgatgtttttaacgaaaatggaaccgtgcgtcagaatgcgtttatacacgacaaaaaaaccggtaaagctaatttgctctacctaaaaccaattcaaactgatctattaacttatcaagcttggtatcaggaacaaaaactacactcaacttggttatttccttcaactcaacaccctgatcgacacattactgaaaagcaattttataaaataatgagtaagactggtgacttgttaggtattaattacttaggcacacatacaatgcgtaagacaggggcttatcgcgtctatacccaatcaaattataatattgggctcgtcatgaacttgttaaaccactccagtgaagccatgacactaacttatttaggcttagatcaagctagtaccgaaaatatgttagataaaattgattttggttaattcccttaaactcaattcatcaacatttgaattctcctttatcagtaccggtcatgtcgccagaacataagcttttctgcgtcccaatccgtcagcatctctacggccttgaccatcgcccagaaactgacaatgatggcgccagcaatcagtaccatcagaactaacccaagaatactcccgccgaaagggtgtgatctcgccaacgtcagcacaaaatcagtgagcttgttaagtcctaatccacgccaaataccgtcccagagaagcgctttgaacaacaacagaatcatggacgcaaaaaataggctcacaacgccaccggcaaggggcggtatcaattctcgccagaactgtttcttctctcgttctgctagtctttcccgttcatcgtccagtttggcctgtgcttcattgaccgccttactacgccggtcaatgtctgccagcaactgcctcttgaccccctccacgtctagctggctggcctgctcttgtagtcgggcaccttgctgttccaaaatcttgttaacctgctcgttatagttcgtctggtcgctctttaattgttggctggcctgttcctttatctcggcggggttgactgcttgggccacctgtcgagcgacttcttgccggataattacttgaatagcgggaacttttgtaaagtcgatttccccgttatcgtaagcttttaaaagctgtaccagtgcctgttcgttttctgtcatagttctggccctccttggtcatgcgttcgctcacggtatttatgggcttgcctcttactcctatccgagtggagcttcttcaagaaagctcccgccacggattcttccggcggtgccggcttagcttgtttcgccttgtcagcattgagtttcttcaagaaattgtctgctacgttcggcgtgggttccgctggctccggctgggctggttgctcggcgtgacggtcagcttccgccttttcctgtactcgttttctgatgagctcggttagctcggcaatccggcggaacaggtttctggcttcttcttggattttggcgattgtcgcgcttaaactgctcaaatcccggttgcctgccttgatgttgttgttggtttgaactcgttctgaccggtcgcccatctcatgggccacatggccttcgtggatagttggcacctgttcaaccccttggcgttcatagcttcggtgatcaatttgttgttctggcgtcaagtactgattacagctctcagcccagttggctcgccactcctcggcattgctccggtcgttccaatccgtgtaagattcggtagtgcgcttccacatcttccggccacgggcgccaattttctgctgccccgttttagggtcgatttgcgggactttagccccggactcgtctagtaagtaggtgctcttctgcttcggcgcccacgtgccgttttgtttgattgcacgggtcgtgagcatgatgtgggcgtggggattgccgtcctctttgtcatggattgaccaatcggcgcacatgccacggtcgacaaagtttgcctgtacatagtcatgcactagttttatctgcgttggacgttcaagttctgccggtaatgccagctctacttcacgtgcaagttgtgaattggacttagattccttctcctcaacggcattccagagttcttctcggtcggtaaacttggccggtgcttgcgcaggtagttgtatctcactgtatgcaacaccatgctttttagtgaagtctttagtttccccggtctcacggtctttgagcttactgccagaacggtaagctgacgaagccacggccgactggcctttacttcggctgatggttttgagtgataggtggtagattgccatgacgttgacctccgattctgacgttgaccttggttttgacttatggggttgaccctcaaaatcctgttcatcattaggagcctaaaggcgacttttgatgatcgagattttgtgagattttattttttgatcaggcggaggagaaccgcctgatcaaaaaaacgaaaatcgaatgcacttgactttgattctgccttgccggcaaggcaaccggcggtagccccagcggatcgagcgcatgagcgaagcgaacaatatgtatgcgtagcgtacatataagtgcgcccttagcagggagcaaccaattcataaacccagtatagcattcttatcttgtaaacagtatacttcatttgtagaacaactagtaattaaaaagggagttataaaaatgtcagaatccaatgaagatattaagaaaatagaagctcgaattgctaaactagacgaacagcaaaaacaactcaaagcaaaaaaaagggtcttacgtaaccggcttagtcagcaagcacgcaaagctcggactaaacgattaatagaaaaaggggccttgctcgaaaaattcatcggccctgatgctcccaatcaatcgctagaccaaactcaagctatcttacaagaattaggtaaggataatcataagtaccaagcattaaaaacgtttacaaaaagtgttaagtataaagacagcacatcagtattcagtcgtttccttgaaacttacggtgaacaataatcgtcagacagcaaataagatgcttataatcgcttccaagacgttttaaccctatttgcttggaatataatacttgtctataaattaaagcgcttatctgcaagaatagcatctaaataagcgcataaaaaatcccctttatatataaaggggattttttacttaaattattttagcatgtcttgccagtcaactctataatagccggaaccggcacccacttcgagtggcattcgcatgactggacgtccacctttaaaagtaatgctttcggatttgatcgtgtccgctttagctgaagcagctaaagcattttcagtaaaaccaaatgccagtaacccggtaaataaaataagtgaaagttttttcataacattcgtctccctaaaaggtttttaaaagcaataaaaaacaaacttggtattgaaatggcgataaggagtccgctaacaaaaaaactaattattaaatttagccagtcattttgataatcgctgcgggcttgtaaatctatccggttactaactggattagtcgaatcatggtacaaatcagacattttttttgtggccttatcttccatatgaattgacagtgattgcagagacttcatatggaaattgatttttttaatactaggcaccgtctctaacaataatgggtatgcgatcagaaaggaaatagtccaatagacgttaacaatactccattttagaggcatactgccatctggattagccgtcataaagtaaaatactattatgaaaaatactagtccatgcaagtagtcagaacagattctttttagtaatttcattgagtattctcctaaactggttagtcggtcgccttgcattataatctttttttaatcataataaaacaatactcatttttgataaaaatatttcaattttcctgatgatcaatagctatcaggaaactgtcaatcggtaaaggagtgggaacataaggaattaacagcttttgactagtttttacaccttttagcgtataaagctgattaggtttcttataagcacacaaaaaggcctatcaattaatgacggcctctttgcatacttacagaaaatcaattcaaaatgaaagatttaaattaatacgccgttaccgtcagtgcttaaaccgtcccgagtttcaccttgtgaacgtacatagttatcgaatgaacgcgtttcgccttgttcttgtgggtcaataatagtttgtttagtcatatcttgtttttctcctttttgttggttgtctaaaaattcttcataagaacgcttgtctacttgaacgttgctgtcgtcataagctggaactgtgactgtacttacctcgaacaagtcttttacttgcttgatagtgcgtacaaccttgccgctttcgtcacgggtgaactcgtccccaccgtcatcaatatcaaatcggaagctcattgagtcaacgttgccggacttaacgttctgataagcgtcattcgcgtatgaaactgaatcatctaacgtggccgtgaagtgcagccctttgtcgtccgtatcaagctttaaagtaccagccttaacgcttgccagtggcttggaatagtcgtgttggtctaacataataacgttagataaatcaacattatctaatgctttaggatcaatcacttccacgaacccacctaagtccttacttggtgagttgaataataaagcataaccctcgatcgtcttaggttgttgcttgtcttgttgttgttgcttgtcatctggttgttgttggtcgccagtcttagtgtcgtcttcgggcgtggcgccttgcggctgttgtgctcgtagttctgcattagcgaccagtcttagatctttaatcaataccgttacctcctaatttttgtttagcttcatcagccgtatatacaccggccttagtaagttcaataatgttatcaatatcttgttgtttattaattcgtagtcttgaatcgtcataactgacttgtttgccaagtttgaaagctagttcagttgtgaagcaatccatatatctgtaaattgttgattgataatactgtgctgaaacttgtgaaacgctcgaatgcacttcctcaacgttcaatgaactctgcggcaagccgaaacacgacgcgattttctgtgtgctgaattcgttcgagttgatagctttcaacaagccctcgtcaacggtcaagcctttcaagtccatggaatcatctaaaataaccgtgctcaaagcacctttgttcgcttgttcaaatttgcttctaatgttcgctttagcgtcactcgaaagatcggttttgtgcacttgtaagacgttgcgtgacggactatcaaagaagcctttaagcaaatcgttgccttttttttgcaacaagatttcagattgcaaagcgtaaagcggtgaaataccaactgcaccgtcttgtgtaaaacatttaaaatgtagaatgctgtcaggcgcaatctgacgacttctttgcccgttcggcgtatagatataggtcaactgacccgtgacgtcatcttgctgaactgtaatttgactgttaggaataaacttgaatccgtcatcttgaattaaggcgaacgagttacctgacagaagcaattgtgaaactaacgcaaacttaaaatcatgcccgttcatgtttgaattcggtctatcgttcagccgtgtttcaagtacgcttgacttaggcactaaaatacgattgcttgctagatctccggcaataatgttaatcgccgcgaacacgtcactgttacgcaacgcacctgcacccacgaacacgcttgaatcgttgctcgacatggaaacaatcgcgtctaaaaacgctgaatttgaatctgcttctatttcctgtgaatcaaaaaagaaactcattgtctaacctccttcttttcgtaattgattaagaatgcaacggctattaagctaatacccgtgcaaactaaaaaagcccctgcaccgatcatggtcaaaatgcctaaattaataagcaatagtccaatgattagtagggttgtttgtatatattgactaaaaagtaaactcgtcactcgtgtaaaattcgttaatcgcttcatcactttccaccccgattatctcgttactggtataaacccacgcgttcattaaagccgctagtgggtcaatcttttcattgtttttcatcttgtttatccggcaattacccgttgagtcatatataagcacgctgttgtcgactgcgatactaaataaatgattgttcgggtgtgtaatctgctcgtttaacaagtattctttgaattgcttagtcgggaagcttaacgtcttgttattttgcattgtctcaatcaacggccagtcttcgttctcgaattgccctaacaaataaccgaacgaccatggatcgtagcagattgcttcgacttttaagttattttcatcaaccatatgcttaataaagtcgaatacgtcttgatagttgataacgccactctctaaatcggtaatatcacactcgccagcggtcgctaacgccttgtaattgatattgtcttgtttcatcttttcaagtaaaccgtacttggtagctatccacgagtgactatcgcaataataagtcccgtcatcaagtgggattatccagcttacactggttaagtcattagacttacttaaatcaatacctattacaactcgtttgccttgtaggcttggcttatctacgattgtcttagcccactctgaatgactgataaagctatcgctgttgctttgataccacatattaaattgtttaactaatacgggaactaagtcaccttgctggcgtgctgtcgcaacgtcattgcttaagttttcactcattaactcgttcacgctcggtacctcgaataaagggttagccttgatccaacaagcttgattgtttacttcttctcgatcgtcaagttcccaaatagcaataaattgccggtcgttggcttgcttattgttgagaatatcagccataacttggtagtcctcaaacatagcaccttttaaattgaagcctgacgttgaaatgatacataataagccgttcttttgttgtcccatgcctgactttaatacgttgtaaatagcgtggtctttggcttggtggtattcgtctattatcgctgttgtgggattgaagccgtctaatgtttcagctttaccggcaaccggcacaatgaaactatcgtcatcaagcttggttatttgtttctttttaatatctagtttgtttcttaggctgggacttaacttcacgacttgtcgtagctcgctagaagccatctcatagccgattttagcttgtttaagggcgttgctgacaaataatacttgtcgattcttagctggcttatcttcgagtaataggcttgtgattgcgatacaactagcaacgtacgtttttgagttcttacgagccatactaatgaaagctttgttataacgtctattgcctgtccctttttctcgccagccgtaaagtgaaccaattaaccacttttgaaataacgccatttctagcttcgtaccgtccgttttcggtataagcgacataaatttaatagccttgttcgcttgcttgctatcaaagtaatagttgaaatcgtcacgtttacggtcgcttagttcacgcttgcaagctaactttattttgtcattggcaactatttcaccgcttaaaactttattgcaataatctaatacgtaatcagtcatcactaatcaactcggcgaacgggtcgtctacgtttcccgattgaacgttattgagtagttgcttaacacgtgcgttcatagttaaatttaagtcacgcaataagtcgttgacgtttttcaaagctgaattgtatacggtagtcgcttgattctttttaccatcaatcatgataccgttgctgtggattgaatctaacgcttgttgcaactggtctaacgattctgccagcaatgaaagctgtaagccgtcaatttgtgcaaagggcacgtcactatcgcttaccagtgttagtaataggttaaaaaacacttgaccttgatcgcttaaaataatagctggtcgtaaatttaagtcttgatccagcattgacttagcttgttcccgtgtttgcttctttgttcgtgattcgtgcgaattattttcaagtttaatcattgactcctaacccccctagtgttagtatatatgtattcaaaaagccgttaaataaaggattatacggcttagtgtggaaaaattttttatttttttaattaaaaaatcgggaaatttatttttttgaagtagggcgctcattgtcgaacgattaacatggcccccctaatattattcgtgtttagttaaatagcctcatggcttattttttttgctctcgttcagcttgcgacttcaaactgtggtggtaatcacataaactctgtaaattgtcccagtcatacggttcaccaccagcaaaaagtggcacaatatgatcgacactcgttgcaagattaatcattccagccctttttgagccctgtttttgagccctaaggcaagcctcacatatcggattggcttctcggtacaatctgcttgtttgtctccaacgattgcttgcatgaatcgaatttgaatacatacttgtcttacttatgtgttgttcttttggtttatgtctctcacaatatctttcattcaagtttatcaatcgtttacatccagcatgtgaacaatacttcttactaaccattcgagttagtgtctgtattcgttgtactatcgctcgttgtgtcgtcactcgatccaccaactaaacttaatacaatcgtatcgtaaccattgacttcgtaatctggattgatacttgcaacgttataagttttggtattaggtaaagtgatcgtataattttggtcattcattgcttccacgaatctgtcatcatgtcgaactacaatcgtaactttatcctttagataattgaaagcattgctactaattgactgtgacaatgactgcttataataaccataatagaaatcaaatagttttgtattcacatcaatcgtgtttccgtttggcaactcttcatatcctaatttgtttagacttgctttatatcttaatctacttaatgtcatcttcatgtgtgtaacctcctacatatgtacggtggcaccttagccaccctatcactagtgcacgtatactttactgcgtccgtttaattcagctggtacgttgtaccctttacctctagccttgctggttgtcattgtttcaacgcctagcgtctcaaaataacctagcgcctcaaagctgtttaaatgtttctttaagttgtcctcgtcaacgcttgtccctgctttattcaatgtaccaaagccgggtaatgacgctactaactcgtcataggttgtgacgtcttgcgtggtcaacaacttagccatcttatcaatctgttggcttgttaactccaaccgtttacgcttaggctggccggtaattggcagcattctatcggctaccttgtcaccatataccgcacgcacggcgtccggggttaacacggtcttctctgataactcaacaacccgttcccaatcggcgcactctggatcattgaagcataaataaaaggtcggacacttatataagtctgggtagtgacgtgtaagtaaagcttgctgattgtcgttcatgctatcaaatggtagccgttctaattgtccggccacgatcaaaagattaataatgttcgttagcttactgtcgttcagattcttctttgtccgcgggtctaagcgatcataaatatgattaattgccagtatctgcaccacaccataataggtgtctttagttggcttatattgcaaagggttgaccaacgcttcaagccaaattgcggttaatacttgctttagccccttaatattgcggaatgctttcttcatttcttttgattgcttactgctaacgctcaaagtattaagtgcgtgttcagcgtgtaattgtacataacgttgatattttgttgttttaatattcaaagctttagataagaattcgctcatcttaccttgtaacaagttctctaagtagcctagtaggtttactcgtttaccgtgatacttaaccacgtcaattggtccggcaattacttgctggccggtaatagtcccgatgttgtagttgtctaataactctgcacgatcagtggtaacctcatgcttatcacgcttagcgccctcgaatagcgccttaacgtcctcaatattatcctcaaagtttaaaatcatttgttcattttccataattacaccctttcaatttgtatattatgtacaccaacgagttttcactcgttggttaggaggttggaaataaagacacaaaaaaagcgtacgtttataagattgccggtttgccagcagggtaggagccctagtctcataaacgtacgcttacacacgtatgtattatttaattgataataataatcaggctcctactcgtgattatctatgtactcggtgagggtgaacgatgcccccaccaaaagggtgtgttccgtcattgcttacacaacgagcggactgtgcaaatggaaaaaagcgcagtatgtactttttagtctatctatataactcctaaagtagtcgaaatatgaccatatttccctgatttttggtaatattccgactactcgcaaaaaattatttttacgtgtccctctatataactcccaaagtggtcgaaatatgaccataatttaacgttttttggtcgtatttccaccacttgcaaaaaatttatttttaaaagtccttacactacactcccgaataagggaaaatattaccaaaaatcaaccaataatggtcgtattttcccttccgacaaaaatatttttacccttacatatatgttaaaaagtggtcgaaatatgcaggttttttggctatattcctgcatattttgactatcgctattaaattttattatttcttaattattacaccctatatatatctcccaaaggggtgactagatggcgaaaaaacagctaaaaaacgacatttcgtcacccctaatctgaatcttaatatttacttaatatttacacctatctatatatctaccaaaagagcgactagatggagaaaaaaacgtcaaaaaacgccatctagtcgctcctgataaaaaattattatattacatcaattgtgataatttattattatgtttactatgatcggcaatgcttgattgcttcaataattgcgctgaggcctattccaatgacaatcaacacgtgaggattgacggctacatacatgaggccaaagcctaatacggctaagaatatacatgtaagaatgagtgttcttataagcttaaatatattcaatacataggcctcctattgtgatcgtgataatatgctcacactttgagcgtcagcgaattagtgtgagttagtgctttagcacttacccttatattatattaatttactttattcacgtgactaacgcactcactacgttcgcttgtttttgcttttgcaccgaggggcgcgcaaaaggcaaaagtaaaaggcgccaatcgctacgctcataatatcatgttgttaggggtgcttataacaaaagttgaatctctgtaagcctactggcacaaggagttacaagtttttttattaaaagaattttgtatatgatatagtattatatatctctctatatcatatcaaaaattcttttaataaataatcgctgtgtcactactcccacaaggagttacgagttttaagctttgttataaggggttctaagatggcgcaagccaatcacaacatgcgggcgagtggtctttgcgagacaagcgacaagcaaaaatgaaatttttgtgcgtcagtattatattctcgtctattacaagcatagtattagacacttaaagcatgattttagatattctaaggtatcatcaatataattatgccacatacacttaaaacgtcttagaacgcttgtaaatgctttatagggttattccgttatatagactagtccacgtgcatataatctatttacgagccatctaagctatgtttagttgtcagtaatgtaattacacttgttagcgtataaagttgcttaggttgcttgtaagcacacaaaaaggcctatcaaattaatgacgggcctcttggtcgttacaaaacaattcagtacctcaaaatgaaaattaacggagtgttcatgcaaacacaagttgtattatatcatggtcaaaacatgctgcaaccaataaaaaaagtgaacacccgggtaagtgttcactaagaagttgttacttcgaaacggaataccatgagtcccgactaatagagacaactttattttagatcattctaattaaattgcaatataaaaaacctatccaattaagggtaggccttactgtaaacacgaaaaactaagttatgagttcattcctgagcacactttttaagtatagcacacacattattataatagcattaaaaacagcatagtaaaaaggtctatccaaactggaatagaccttttatcgtgctcagtcactacaagactgttaaatgattgaagggttactaagtaacttgactgagcacatatcgaagtaggcatacttaacgatgactgagactagcaaaacttgttaggagtgtttgcaactaccagagtcagttttcattataacactattttaagctagttaacataacacatagtattaaaagctaaagtttgtgaagcgttaaaaacgttgctatatcaacgatagcaagctatatatttacaaatatcatgtgataaatatactttgtgaaaatagagtaaatttgtaaatgttaatataccagtattttacacttgtgaaattgtattattttgatcgtgtaagtcactttgtgataatcatgctctatgtataattgtccgaaatatgtcggcttagaagtcgcctcggccgagactatataatattgatagtgtgtctgtcgttagtagctagttcttaacgtcttgtggtctacgggacgactagtatattaagaacaccctagtccagctcactggcacgcatagccgtgcttaaaccagcaagggtcaagcccttaggctctctcaaacagttatcctatcagtgaataactgcgcttcttttacagtataaagagagaactctttatcagacaatttaagctcaaccagcccttgcaccttgctatcattagagttagttttaacagcaactcaagtaatctgtattgatagtaggcctgtccgtatcatttcctagtcttcctagccacgtctttagtcgcgttgatctcaacaaggtttagcatacctatgatgttaactacaagcggggtcacgaaccacgctcacgggaggtttcactagctaagatcaggtttccggcctttagttactattatggttgctaaccactgaataacaaaaacagttgctatcaggtttcttttaagattcccgataacaaccgtttactctaagtatcaatggttgaaaaacttggtatacatgctataatgtaaacaagttagatagcttgtatttgcggtacttgctatcgaaaatcttatcagttgcgtctgataagtcgtgaatcctaactctgctaagttgagggttctttttttgcgttcatttattaagttgagtacattataaccgtaatatcatattaatacaacctttatcattttagcgtcttagccagccgaataagccctttttaggcgccttaacctcttcccctttataatgatccccagtaggttctaaaatgtctgtatcgtcctttgagacgtcttcactagtattctgtggggcgtcaagtagcttttcattttgccggttagtcgatagattgagttgctgttgctggtcaagtaatgactgcattttatctaattgatcgtttttccgttcaagttcacccttcaaaatttctatctgttcaagcaatattcgtgaagtgtccgctttcgtttcagttgcaaaatgaatggaatcatttgaaaatgcctttataataacgtctttagtgtgttcagagtatagtttcgcattccctttcattgaacgttctgaaatgttattgtcacgaatgtatcgccatactttagttttgttaacctttgcaatgtcagcaatttcagatattttatataaccgttcactattattcattgagcgttctcctaacgtttttgaatgttcactgtgatagattataccatttcaacactgaacaagggcttagaatacgtctctcaaaatactaaatgttaaattttatttatgtgatttataatataaaagtattacagttaacacgtatcataaaaataatatagagagggtctataaaaatgaaaatagaatttactaaacgaagtagtcattccagtaacgcaattaacgacttttttacaattactatcaaaaatggggagaaatattctttgagacaatctgttattgttgaagcacctaattcagatgagtttgtttattctaaaactactgattacagtaaagtcccccttgttcttcacaaagaatacaacctggtaaataccaaatctaataataactatcatggtacaggacttgttgtgttaccaataattcatggagacaaagttgttaatgatgatgaaacatttaacacctacattcatatgacatcagatgagttaaaaaagccaaaatatcaatatggattaatcaaagaagacttttttgataaattaaattaaattattatgtacaaaaaggcaccacccagttatgagtggcgccttttataattagtatttaagctggttgataagtgcccgtagtgtgaacggaaagtctttcgtcacggtatcatcaccacgattttgatacataagttcagccagtgcgttaatgacaacttttgcacgtttgctatcaagtcttgtccctgctgcgtcttcgtctaacgtgctagataggtattcttttgcaccgtctaaatatgattccaaaagtccatcatcgtcttttagatcaagtgggattcgtaaagagttctttagtgtgtctaattgtgttggtgtagtgtttgtgtctgccaatgttctttacctcctaaaatatggattttattatatgtatagcgagggttgcccctcgttaatcgactacttagccgtattgatagttaatgctaccgtagctgtcttgtcgataaattcgtagtcattgcgtaacatgatcgctaacccttggctgtatgaatcaaattgcgtccacttcgtggttacttggttacgccggaataccgcaatcgtttcggctaagtcaccaataaacatagtgaattgaccgtcaccagcgttaggcaatacagtgtcagacaactctacgactggtaaaccgaataatgcccgaccagtaggtgcttgaatgtcttcactcatcaagtaacggccctcgctatccttttgcgtatctaaccagttgaaagctgattggttaacaatcacgataggttgtaatgatggatctaattgcgtattcttagcttgcttgataccgtcaatatccttaacaaccgttggcgtcaaagtcttcaacttagccacgatttgtgcgttgtccgtgttgtcgactaacttttgcatttgtgcttgaatttcagcactaaagttgatcgcgttgtcgtcaaccaattcctgtgaaaggtaaactttgcccgcacgtgtttcagtcttgaattccacgccagtaacttcggggtcaacgtcaccaatcgcagcattttctgctttagttgcaagtacctttgaagggtcatttccggcaataggatagctaccttggcctactgaaacttgtttgaccgttgcatagtctgataagcggttagtgcctttcttactctggaaaataggtgtgataatttcacttggcctgaatagacaataatgatataattaatttatggacaaaacttatattctgcttgaaaacagtaacaattctttattcttgctaaactgccaaattttagtgtctaaacacagtgtgatagggcgtgggcgactgatttcctacaaggagggctattaatgaaaattggttatgcacgagttagttcaactgatcaaaacttggcccgtcaaattaaagctttgaagacggctggttgtgagaaaatatttaaagaaaagcaatcgggtaactcaacccagaatcgaccagaattacaggcggcaattgctgatgtgagacaaggtgatacattggtcattacctcgttggataggctcagtcgaagttatgacgacgccggtgatataattaaacagattagagataaacaagttaaaatggaagttttagacgccccgtttctttcaatgcaaactggtgactcggatatggataaatttatgtttgacatgttaaccaagcttttggcatatatggcccaaaatgaacgcaagaaaattcgggaacgtcagcgtcaaggaatagagattgctaaagccaacggtaaataccgtggaactcggcctgtttacgctgaagattcacctaacctacaaaaacggtttatttatcacagaattgtcgaacaattaagaaacaaagcaaacggttctcaaattagctatcgagcaattgcgattgaaactggcgtatcagtgcagacagtgattaatattaagaatcggctgatgtaactattaagtgtacgttttctgaacgtgtatttgatacgtggtcaaataagatcgtaaactgatgaaatagtaaatggatactcatgggataggtagttagagaagtggggactaagggcttgtttgatctaagcgaattttatagcactagttgaaattttttaaggtagagatactatcaatatccacaattttttctacgtcttgtcaatggaaatgttgttaaatcaccgattcatgataagaaatttagggcattggttcggtgacgggggctttcgtcatcgaaccaatgccctattcctgttattttatcgattttaagctagttaaataagccttggaggtttaaacttttttcaaggctggtattatagatataacgaatgttgcttcgattgaggtgctagctcataggagtaaggttgattcgtttttattaggtataggattgttttgataaggcgatccatttgacggacgatgagtttcttcttcgaggaagaggcttctcgtcttttttcgtatgcatcgcgaatgtgattgttacccattttagggttgatcataagaacgaccgtccaatatgagatccttcgtgcgtggggattaccgtgttttgtgatatgacgaatcgattgatggtcgccagaatctacttctgttgtgtcgatacccacgtaactatttaattgttgtcgagtattgaaacgacgcatatcgcccaactcactgattaatcgaataactgcactaccaccaattcccggaatcgtttgaagaagttcatattcgggtaaggattttccgagttccatcatgcataagacctgctggtcctgcgctgcttctagtgccagaacttgttcagctaaggctttcatttgtcgcgtgttatccgatttaaccggaactgcgtcgccattattagcggctaacttccataactttcgtgcggcatcgtgtactcgccttgatcccattcctttaaaatgagctgctaatatctgtgactctaattcgttaaggtcgtcaatgtcacggacgactggcgcacgagaaaagaggaccaacaattgccaagcacacttggtgtcgaaattaaacccgattttagcttcctaaaaggatgcgaagacaagttttaagactcgatgagcacgattacgagcgcgtttcttattctcgtttaactgatcgtaataacgattcatatccgttatttcacggtagatgggatcttgtttataagctaaaagatatggtcctaggtgttctgtgaactcggtaacttctagccggcgtgcatcgcgttcgtcgttctttctcagccgtgaaccggtggcgatacgattcttggccgtcaatggatttaaaatgtgatagtttaagccggactgttgaagaaaatattctgaacgtcgtgaatagacacccgtagcttcaaaaataatttcggagttcccaccgaactgaagcacgacatgtttcagttcattaaatcctagtgcgtccaaagaaataactaactccttgaccattactaaatctgtcgccaccgcaatgttggctttattcttgctaacatcaatcccaataattgttcgcataatcatatacctgtctttctgaagtcttcacgtatattctagtaatctcgttttcaaaacacggcttcaagagcctaaatactttgaccaaattgactaaaaccagcgaagcggccattttttgtgacggtctcaaggaaccaaaagcacccacggcctgtcttcactaccactataaagtaatagaggcataggagcaccctgtcgggtaacctctatgcctctaagcttaggttttttgtggttttaattagcttgaaatatcagatgaattatattatttcatctaacaaccataaagggatcataacatagctttaaattttatcagatctcactggattatactgaacgaaaaaattagctttctttgatagatttgtgataaatactattttaaggaaaactgctctcagttcgaataattttcgtattaaatttataatctgcaaaatacagttgcttttcttcgtatttaggcttagtattttgcaatgctatatttcaataattagcgttgggggcaagcaaatatgaataagcaactagaacgtttttcttttgcgggggcacttgttactttaggaattgtgtacggtgatattggcacttcaccattgtatgttatgaatgcattgattggtgacgccggtaaaatgggaaatatttctcccgattacgtgattggatcgatctcgttgattttttggacattaatgatcattacaacgttgaagtatgttgtcattgcaatgcaagctgataataagcgtgagggcggaatttttgctttatatgcattggttcgagaaaattcaaaatggttaatttggccagctttgattggtggggcggctattttggccgatggaacattaactcctgcagtaactgtgacttcagccattgagggattaaaaaaacaacaccttggccctgtggtatttagtaattctcaacataacgtcttgattatcacaacagttgttctactcgtattatttatgattcaacgttttggaacaggtgtgattgggaaatcctttggaccagtgatgattttatggtttggctttttggctgtctttggaatcgttaatctaatcaattatccaatgatattgaaggctatttctccctattatgcaattaagatactcttcagtccagttaacaaagtgggaatctttatacttggaagtatctttttggcaaccacaggagcagaggctttatattccgatatgggtcacgttggcaagaagaatatttatgtaacatggccactagtatatagcaccctatttttaaattacttaggtcagggggcttggataattagacatgcaggcgacactgcttacagacacttatcgaacttaaatcccttttatgaaatgctcccagggccttggcgcctagttggtattttgctagccacactcgctgcaatcattgcctctcaggcgttgattacgggttcttatactttagtcgatgaagcaattggcttaaaatttttacctagaatggttattagacatccaagtaatataaaaaatcaaatttatattgcaactgttaactggatactatgtataataacaattagtgtagtctggttctttggtagctcacaaaaaatggaggctgcgtatggtttagcaatcactattaccatgcttatgactaccgtgcttttgcatgaatttttaaataaacacctaaataagggaacggcgcttataattgccttgttttttggttttattgaactaatctttctaatttcaagtttggttaagtttattcatggcggttatgttaccttaacaatcatgttgggtattctttatattatgtggctttggtactttggaaataaacgaagagaacattatgaaaaagaaagcgagtatgtttcacttcttgactatcgtgatcaactctctaaattaagcgcagacaatacaatacctttgttcacgactaacttagtgtatatgactaagattaagggtgattaccaaattaagcgtagtaccatgtattctattctcgacagacaacctaaaagagctaaagtttattggtttgttacagtcaatgaaaccaatgcaccttatgaaagtaattatacagttgatttacttgagacgcataatgttgttaacattcaattgtacttagggtttaggaaatctcaatccgttagtatctatttacatcaaattgtaaatcatctagtggaacaaggtattttagagccacaaatacccacatactcaacagagcgacaacggaaagtcggcgactttaagtttgtcattataaaggaacaaccagcagatttaattgtcaatgatcagttaagctcgttagatagaagattgattgggggacgcatctatttgcagaaaattacggcctcacctgtttcatggtatggtttggagtttagcaatgtcatagaagaaagttccccgttatttattactcaagatcgggatcagtacttaattcaaaagaaaatttatcatcgaggtagcttaagtaagaccgaaaagtgaatatgtagcagtttaagtgcgacaaataagttaaaaaaattatatttaattttaattaatgacctgatctcagtattttactgggatcagatcattttttgttcatcgaaatacgtttagtgttttactataacacgtctttagcaacaacttgttaaaatctcccggtttgtaaaattaagttaatactaaaaaagccatttgtggtaggcttttgagcataaaaatcaaaagtctaccacaaatggcctacattcagtttactgtagacaaactcaccacgatttatttcttttggaaagccaaggtaaaaacttatctagtttcctcaaaacattcttaactaccacacaccacttgagaaatttttaaatcaaatcactgatgaataactgaaaatttctaacttgatttgacatttgaggtcattcaacctcgcttcaaatggcttagtcacctactagtagattatacataattggcctcagggccattatttcttcagttcttgaagtcgctgttttaactccttaatttgtacttgtatttcacgacctatatcagtttctgccacggtacgccgcttctcttcagtctctacgactcgtttagtcgacacaatatcagttaaatcacgtattgctgctactttagaaataaatggctcgtgtgtgaccaactgcataccaaatgaattatcaagcaacgtatacccaccaatgccggtcaccttttgatatggtcgtgaaaagccaccatcaatgaccaccattttcttatttgccatgataggcgaagttccttttttcaccggtgtatgaccatttacaacatgactggtatccgggtcaagcccgaatgcccccaatagcttccttacaaacttctcattatgtcgcagttgatagtatggatttgggttttcattgtgtgtagccttatcagcgataaagtaacgctcaaacgtagtcatattttgcttaccaaatagtggggagttggggccagcccacatataccacaacaaatccatagacagattgtctttcctatttatttgtgaataactgtcccgcagattttgttctaaaaaatcgaataactctggcccaacatattcatgaccattcaaaatcaggccaataaagtttccttgctcatctgttggcacacatccatgaattaataggttgttattataacgcagatacatactaccatggctcattaagaatttcatgtgacgttgtaacttttctgaatgcgtaaaagccatgacaagtttatcaataatagcttgttcctcatcggtaagtgcatagggattctttacatctaccaactgaaagcacgtattactcaaagtataattatgtccgagaagtgttatatacttcctgtctgcgctaattttatcaagtaacaatcgtttttccatattaaattctggtcgtctctttaggactgcaccttctaacttaaattggatgatactgattgcttggtgtattttagttatttctttggcttcatcttcttctactgataaattagatgaattactttttggtcggaaagccagattatcttgataataccgttcagcaaaccgtgctaagtgccgcagattaatgccataagcatcttctaaaatagtaagattattatatcgtgcacagatccgaatcaaattacaaatacatattgctgaaccagcggcacctcctaaccagagaatatcatgatttccccactgaaaatcaactgactgacggtcgatgaggacatctactatcttatcaggcgctggtccacgatcataaatatcaccaactatatgtatatgatccactgtcagatgctgaatagttgcacaagtcattttaatccaggaatccacttgaccaagttcgattaagttttcgataatagcccaataataggcttgtttatcttggtctcgattatcactgtacagtagttcctctgtaacatatacaaatgctgggttaatagctttacgtaatttagaacgggtgtacttactagcagtatatcccagtaacctaatcaatcgttggacattagttaaataccattgatgtaactcttgactagataagcttgaagttacttccgtcaattgttcacttggataatataccaaaaatgcaaagtgagtcagtgtctcgtttgtcagttcaccctgaaaacaatctcttatcttactttttacatttccactaccatttcgcaccacatgttgaaatgcattaaattcgccatgaatatcactcataaaggcctcagttggcttgggtaatttcaaaatagattccaggttaatcaattctgttgtaattgaagcaacagtcttgtatttattcattctatttgacataatattttttctttccttttgacagatggcttctacttttatactcattattatgacttttcgtttgtaaattaagttattaaaaatcgatgatcatcttaccatagaatgactaactaaaaagaactaccatatcgatcaatcgtgctgtccaagttccaaggacagttaacattttctaagtgatgatgatgcttttattgattcctaacaacgttatcggattaaaaaaacaatattgtgatcataagctaattcgactatccctgatgaattgttttagattcaagcaaaaacgacagctatctggtgaccaaatacgaatatcaatcgtccagaacactctttcaattatagtatataaacactttaccatacacagtaaaaatcaaactattaggaacatcacacgattattaaaaatcagtcaaaataggaaataattttaaaatatccttttcatgatctttcacctgtcctggattttagaagtatcacttggtttctcaattaacttaaaccgtcgctgctgcgtacgtttactaatccccgtctttcgctcaatcattttataggtcataccctgttttcgtaactcgtaggcaaatctgatttgttcctcagaatacgtttttggtcgcccttcccgaaacaacggatcatgttgctttgcatacaatttaccttcttgtgtgcgtgtgacaatcatatcgcgttcaaactgcgcaaaagcactaaatattgtaaagactaattggccagtcggcgtattatcaattaagcccatattcaaaatgttgactttgacattttctttaaacttatgcaatctagtcactcctattctattttgcaatttttaatgttatacttttggctcaacatttcattatctgaatccattaccgtattagacgacataatgtcaacggccatttacattaccatatgataatgatgattattaataacttagttaaatttaatataacaagattacaaaaggtgataaaatgacaaatagcgatgtgcattatttagtaaattttctgaaaaataaaaacattcctaccattactaaggagtaccatacgtacctcactttccatggactaaaagctgctaatgtttttatattgaagaagggaattatcaaaacttcagtcattcttcaagatgggagggaattcaatatttcctatatcagtcagcctgatgttatttcccttctgcacgacgaagcactacaatatgatgagcaaccattcaacgtacgtattgaatctgataacgccaccttctatcagattaatcgcgtaaaattttgggagtatgttaattccgatcaaggtctccaaaattatgtaaaacaatattatcgtcatcgcctttctgagaacttttcccgtctacagcggttaactatgaacggaagattaggcgccttagctaattttctgaaagatatgtccttgaagtttggagcaaaaattcctggcactaataaaatattaattgacttcatagtgactaatgaagatattgccggcttttgtagcattgcaaattatactagtgtcagtcgcatgttgagaaacttaaaaagtactgatgttattgaatttaataatatcaatggtcgacgacgcatagttattaaaaacattcaaaaattaaacgatttgattgcttattaaaaaatcacacaattttcattaggtctattacaaaagacattacataaagatagtgtcttttaacatatctaacattagtgtccgatgttattatctttttacaaacaaagagatctcctccctttgtttgtacttttcacacacttaaacacaccaagttattgttcccatgacaatagcttggcgtgttttattgtttaaaaatggcaaatagaaagtttaatttgatcagtcttgaaaacttgagctgctttgatttttccagtactaaggtgtcctctgtaggcgcaattttgttagttgctctttcccatttgtttatgtggatggtttgaatttacaggtctacgcgactcacaccgtagaaagttataatcagaagccaacttcaaaaatctatcatggaataatagtagtattgacaacctcataatatagtctaaaatactatttataaggttatcaagactatatggaggaaaaatgaaaaaaattggactattagtcgattccgcatcagatattcccgcggaaataaaaaatcaagtaaatgttgaagttgttcccttagttgtgacagcaaacaaccacgggtatctggatcgtgtgactattcaacctcaggaagtgtatcaactaattgaagatggttatattcctaaaacagctagtccaactcttggactggtatcacaatatatcaaaaaattgcagcaacgaggttataaaaaaatcattgctattacaatctccagcggcttatcaattacaaataaggtttttaaaatagcttctgaaaatgtcaataacgcaatcataacagttattgattcaaaaagtattggtattggtagtggattgattgcagcatacgcagaagacttaattaatgctaattatgattaccaagaaatcactaagcgagttcaacagtccgtgctaaaaagtaaagtctatttttatattgcaacattaaaatatcttagaattggcggtaggattggcaaagtggctgggatggtgggatcagttttaaatattaaaccagtcatatcgtgcgactcagatggcatatattacccagtagcaaaagctcgttctgaaaagaaagcaatttcaaggttattaaagctggctatcgaagatgcttcaacaaacgaaagttttaggcttgcagtcgctcagggcaatgacaaagcgatttcaagtcatgtactaaccgaacttagaaatagctttccaaaacataccatttatactggtgatgtttccccagcattatgtgtacacacaggcccagggctaattggaattgcagttcagattgattaatatttctgtgcaaggaggatgactaagttgcctttcgctaaaaataatttcccgagattaccgttatggagcgaattaccaagcttcaatttacatttggatcaattattagacatcacaaattcttttgttgaacccatgattgaggaaaaaattaccaagacaatgatgcataattattttaaagcagggattattgaggctccaatcaagaagagatatgcacgaaaacatttggcaggagcaattgtggtcggtgtatttaaaaatgtattctcactatcagaaatagagcaaggattgcgactaattcttgcagatacttcacctgcagaaggctatgataactttgtaaaaatatttaataaccagagttctcaaaaaacaataaaaatgccccctgtagccaatattagtttagaacccacatctactatgcttatacagtatagtgcgattcaatcggttttgttttggtttttagcaagacgtcttattcagaaaaatcaggatctataggaaaattattacgtatttttgtatatgatattttagttatataatttatttttttaatggagggatatttgtgctagacaaagtggtttacaaggaattattcagtaaagcattcgacataacgattgaagtaacttattggaatgggaaaaaagaaaaatatggcgctggaattcctgaaattaaggtacaatttaaacacgaaattccaattaaatcgctaaccagtcagcctaccttggttctaggtgaggcttatatgaatggtgacatagagattgatggaagtatacaaacattaatcgcatcggcttaccggaaaaaagacagttttttaactcataattcattcttaaaacacttacccaaaatatcgcattctgaaaaaaatagtgaaaaagatattcaaaaacattatgacataggtaacgatttttataagctatggttagatgacacaatgacctattcttgtgcttattttgagaaagaatccgacactttgaaacaagcacaattgaacaaggtccggtatatcttacgtaagctagccactaatcctggtcgtaaactattggatattggtagtggatggggaactttattattcatggctgctgaagagtttggactagatgcaacaggtattaccttgagccaagaacaatataactatacacaatcacaaataaaggaacgacacttagaaaatcaggtccacgtaatattggaagactatcgtgaagtatctggtcaatacgattacgtaacatctgtgggcatgtttgaacatgttggtaaagaaaacttaggactatattttaaaaaggttcaagaatttttggccccaggaggacaagcattgattcacggcattactggacaacatgaaggtgctggtgtggatccatttattaatcaatacatctttccaggaggatacattcccaatgttgctgaaaatattaagcacattatagatgcccaattgcaattttcagatattgaacccttacgacgccattaccaaaaaacattggaaatctggtaccaaaactatcagaaggttcggaatcaagtcatcgaaaaatatggtgaacgttttgatcgaatgtggagtctatacttacaagcttgtgccgcttccttcgaatcaggcaatatagatgttattcagtacttattagtgaatgcacctagtggtacaggattgccgatgaaacgcaattacatttataattaactattactaggaaaattattcaaataatgttcaaaaaagggcacctgtttaaaaaatgagttgtagtaaactccattttttaaacaggtgcccttccctagtattaacttatttagagtaggaaaaacactttcgatagtagctacagtttaaagcggcaatatcaaaatcattgtggtagtgctcacaacgtcccgtattatcaacacataatccataaattaagctatccaatatgatctcctttataattaaaaccagttttgattacttcaccgcttgtaaaggtttgaaatgttccatctatccttttaatggttataccaccattatcttcaatcttctgagcaactccctgaataacttctgacccagtatttaaagaaaccacttttcctaaaacaatcgattttttccggtactccgccaatagttgggggttcgtatagtctaaaaatccgtttataattgcttggattatttcggcaattaattgattgcggttaactgaattgtcattatcgatagcttgggctttgattgccaactcttttggaaacttgacagttgttaaatttattcccacaccaacaatgaaagctgaggccgcccccagttcaagatcaaaaatggactccgtaataattccgcccaccttatgataatttagatagatgtcatttacccatttaaactgaaattctttatttggataaaacttttcaagcacatgggtgatgctcacggcaatcccagttgttagtagtccgggttgaataacagtttgttgttggttaggcagaataatactgagataaaggcctgtagtcggtggtgaataaaaagagcgacctcgccttccataaccgttagtctgcttatcggcaacaaaaacggttggcctggtaatacagtgcttactagaaaattgctttgctaaatcttgggttgatgtaacttctttaaagacatgcagattatctgttaattgcttatggctgtaaatattaattaagtcggcttctaaatacggtgctgtatgaagcatgtacccacgtttcttacgactaacaattggataatctcgtttgttttttaaattattaatagccttccagatggtttcacgactgacttgaaactttttagctagatagtcaccagatacccacgtatctaaattggtcaaaagttctaacaccactttttcttgggttgatttatttttcatcaaaccacctcctaattaaatagcgataaacaataactaaaataagcttaaatgcattacttttctaatacggcgaacaataataactgctaaagcacttttaataagatctcctggtataaatgctaagtttgaaataagagcggcaatcaacgtaatgtgagactggtaagagagccatatagcacccaccaaatcaataaaaatcactccggctaataataaaatgagcagttcaaatatccaagacttattgtaaatctgaaaacgattaattaatagaccaattagtaatggcgtaaataaccaagctataagatagccgccagttggtccaataaagacagccataccaccattaccaccagaaagtatgggcataccgatgaaggctaataataaaaatagacatactgagatggtcccatacctaggtcccaacaactcaccactcatcatcactcccatgttttgtaaaacgataggtactggaataaatcccaacggaataccagggaagaggcctagtataattaagattgctaccatcattgcagataacgttaataatcttgtggtgttactacgttccaatatgatcactccaagtatggatttttcaaaaacagtgttattatagctattagtaacccattagtcaaataaagggttactaaaattcgaataatggaagggagactgctaatattgattagtttgaaaacaggcgatctgttacttgttaaaaaagcacaaaataaactgtcagagatgatcattagaggcacaaaacaaacgtttttagatcgaccactagcttattaccatatcgggatagtagaaaaagaaggcactgacttttttgttctccatgcaaccaaagaccatggttgcattcgtcaaccgttagatcaatttatttccgaagaaggattgattgacgtttatcggaagagtagccctttaataaatcccctcaaaatactaaaacgagccaagtccatgttagaagcaccatacaatccgagcttcagattagatcagccaggatattactgttcggactacgtggttaatgcatttaaagatgaaaatatatttcatctatccccaatggtatttggccctaacggctctgttttgcctgaatggcaacagtattatgaaaatttagacttgccggtacctaatggtcagttagggagtagtccgaactcactaattagccaaggccatctcaaatttataggagctatcaacagctgacttttaatacagacaattatttggccatttaggtgaacgattacgtgagtttaaaacacgatcttgctggatatcccatatccctgatattaaaaagactacaatctagatagctggttaatacggctatctggatgtaaatagtttgccttataatcttggaaaaactatgttttatttttatctcagtgctcaataatcgagtctacaaggtaaatagacttaacacctttgtttagagtacggttaaaatcggtctgcttttgtttaaaaacatcgcattgactgctttagcatgttaaccaccaattaagtcaatatttctattatcttgatgataaaacatggcaaaagtgttaagttgtgacctagtttgtgccatttaaacactttaatcatcatatattcaaaatatcaaaaaaatttgtatctaatatacctaagcctttttaacggagaactcttagccacttgtagcgcttaatcacttgggtatacacaatgattattatcacggcaaaaaaacaatcttaatgtttaaatttgcttcacttcaataaaagaccggcctgctcaaacccaagggttttaacggaccgatctttatttacattaaggcatctttacttactttaaaaaacttttaatttatcttagccagttgttgtgacaaagtttccacttgtttagtcaacttctccaaatcgtgactttggttgaaagtttttaaatttgcttgcacttgccgaacgctcctttggacagtttcttggccattagtagtcaaggttagccgcacaattcgtcgatcagtttgatttacttgtgattgaattaaattatcttgaatcagtcgccaagtgtttctggaaattagtgtgcgcgtaaccatgaacgcatcagctaattcactagcagtggcttgtccgtgttgttcaagatagactaatattccccactcacgcattgagaaaccagttgtggccagcccttgcattaacatctggtatgcctgtttctgaatatcttgtagggctgctaagctctcaaactggatcttagtttgccgatgatttagcatataatatcatcctattctttgcgctgccgcttaatcattccgaagagtcctaacaaactactcatggctaatagtaataagccactcagcgtcatgtgttgttgatcagtttcattagtttgaggcaaccgttgatccacaaaattagtagccgctgcttgaccagcctgaaccggttttgctggcgtcgttggttgacttgggttaaccggttttgctggcgtcgttggttgacttgggttaaccggttttgttggcgtcgttggttgacttgggttaaccggttttgttggcgtcgttggttgacttgggttaaccggttttgttggcgtcgttggttgacttggattaactggtttttttggcgcatccttagctccttctaagttgtagtcttttttttctttatgaagaaatgccagaccacgtatgcaataccccaggttattaagaaagcaatcactagtccgtatcctaaccaactaaagtctatattctgaatccaaaaccagactttgccttgagtatgagtcatattcgtaataacttgagctaattcgattgctccaattagaaatgctgcaaccacagaaattgtggtaacagttaagttataatatgctttacggactggagtgtcaaaagcccaagtataagcccctgacatcattacagaatcagtagtatccatgatattcattccagcggcaaaaaggatgggtaatgaaatgattccaattgttgtcactccggattgagctgtacttgcagataaagcaatcaaagcaatttcagttgcagtatcaaaacccaatccaaaaagaaaaccaattggatacatctgccatgaatgattgatgcatttgaagaacggatttaaaattcttgctaagaatccacgattaattaatattttattaagctggtcttcatcaaccgaattttttttcaccgcttttaaagaacgataaaaactaattaaaagaaaaaggttgaaaatagctatgaaaattaaaaagcatcctgaaactaaagagccaattctgccaccaactacttctaaaaaaggtagctttattttagcatatttgactgagacacttactaaaactgccatcaagagaaccactgtagagtgacctaaagaaaaataaaacccaactccgtaaggctgtttttcttgatgaactaatttgcggactgtattatcaattgcagcgatatgatcagcatcaaatgcatgtcgtaatcctaacgagtacgctaacaatcctaatccccaaaaacttgaatgttgtgcagctgctgtgcataaaaacatgattccgattaagtggagtcctagactagcagaataatacggcaaagaaccataaatgatttttatcttcaaataataaaacctccattaagcttcctaataaaatgatataagagttccagcaactcaacttcaacttataatatgggtaaaaaacattaccatttgataatgtacttgtatgcactattgtttgttttgccaaattaagccaagaatagttttgagttggcgaatgataataaaaaaaatggcaacaattttatggtctacggagttttttacgatgcaaattctttagccaatcccaaattaatcttttcctaaccgttttattgtatagtgcttaaatcatctagataatgacaaaaggtcacaacttgccagttgtggcatgatttttcgtgccttataattaaaggattagaattgtgtcattacttaatgacataatgcattaaaaataatcaaatttggagttggtactttgactaaaatactttgaacgattttaaagaaagctatttttacaaaaacgaattaatccagctatgtcgggagtaccatttgccagtttatggtactaaagcagaattaagtcactatgtttatctgtatttaagtggggtgcctgctggaaaaatcaaagcgtatcgtactagcccaactaagccgtctctaaaagcagatgaaatcactttaaagacaaaattagttggttcaggcttcacttttaataatgaagccagaaaattttttgcggactatttcaatagcgaccacttttcctttaaaaaggaaatggctgttattaaacgtcaagcagaaaccaataatgacactaatatgactgtaggtgatttgattaaacaatctcaagaattacaaaatgacagtacgcaaagattacgtgttttaactaaaacaagtgaagaagcaacttatcagtggaataattttgtgaaagatttttgccacagctctgaaagctattactttaacgataaattaaaagtagctgcactcttatggaagcacgttaagcactcaaaacagcctaaaaggtattcacacgatttagttaaaatcttttccaaaggaattagtcaatttagaaagtagatgtttatatgaaatatggttatgcaagggttagtaccactgatcaggaattggcaaatcaacttgagctattacaagtggctggtgctgaaaaattttttcgagaaaagtttactgggacgacaacttaacgaccggagtttcaaaaaccgttgcgtgttctaaaaacaggagatactttgattgtaactaagttgaatcggtttgcgcggaatacgcgcgagacgttagcaattatacaagagttgtttaaagaaaatgtcaaagtcaacattttgaatatgggcttaattgataatacgccgactggacaattagtctttacaatatttagtgcttttgcgcagcttgaacgcaatattattgtcacgcgcacgcaagaaggtaaattgtatgccaagcaacatgatccgttgtttcgggaagggtgaccgaaaacgtattctgatgaacaaatcagatttgcttatgagttacgaaaacagaggatgacttataagatgattgaacgaaagacggggattagtaaacgtacgcaacagcgacggattaagctaattgttaactaaaaaataggtgcgctaagaattgaaaaagatagagcctaacttacttaagatggtttaaattagcctaaaaatgaacacttaaataatcactcactaagaggattgtcgcttggtttaattagttttgagaaaaattgattttgaaattggtggcattatttatactagctatttattaatattagttgctataggaatcgatatgaaccataagaggcccgctcaattattagttgagcaggcctcttgtgggtattttgataaagagttagttactctatgttaattataagacttagtttctagataggcacatgtttatcaaaataataccagattgtacgattgatgtgcaacgtattttaggcgctaaaatgtgtttcataacagttgatagttactgtaaatagtgtgaaacaattaataagaaattaaaattttactaatcttaattttaaactttgcctagcgatattaaaagactgcgtattattagagcttataagctctgataatatgcagtcttttaatgcattatcggataactagtaccgaaattggtgagtatttagccatgtaagctgcttgactaccaaaatgacgtcgaatgccccgcttggcttcagagccaataattaaaacatctggttctacgtgtggaataatatctttcacaatgacttcaccaggttcaccttcagctaccaaggctcgtacattcttgacaccagcggtttgtgcttctttttggtattctaagatatgtttttcaagctcagttcgctcgccgtgaacgaagtctttacttaaagcttgatacacgttcatgtcatctttttccaaaacagaaacaataactaattctgcttcatcttgaattgcttggttaatggcatgcttaaaagctaatttagcatcagcagaatcatcaacacctactaagattctcttaaaagttatactcattatttagcctcactctcagtttgatgagcggccagcttagcggcatatcgcttgttgccgcgatataaatcataaatggtccatgccaataaggctaaaattgcaacaatcagaatattggcaataattgaggaaaggctttgttcagtagctgacggattatcaccaaagaaagctagaattgagtcgggtaaccctttaaggtttaataaggttaaagcaatgactgaaaaccagccagcaattttaacccagagtgagtttttgaagcgttggcccatttctacttcactatttgtcatcattaataattggattgaagtcaatatttgagacagattttaagagacattcagaaccgcgtttaccttccagggttcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggcactggataaacacattcctttttgagggaagcgtgaaaggattccattggcgcattatcatacggacaacccttacggctgtatgagtggcggatatgtagctcagttaaacgttgattgtaatcatcgctggtatactgtgatcctaaatccgtatggataatcaggtccccagtaatggttcgatttttaaccgcgctttcaagggtctttaagactaaatcagtagccatcttttttgagaacgaatagccgataatccgtcgtgagtgcaggtccatgatggttgataagtaacaccagccattacgcttcgtttgaatataggtcatatcagcggtccatttttgatttaaaccagtggtcgagaaatcctgcttaagcaagttgggacgctgttcaaccttggttttggaagccgaagccgctttccacttattgacggtaacggagtggatatccagttccttcatgagccgggaaatccgtcgtggactgcaccgaagctgcagttgttgaagttccagattcaattcatggtggatcttcataacaccgtatcgctgcttaaattccgcaaagatccgcagaatccgttgtttcaagcccgcatcttcggcccagcgttttgaaggtttgggggatcgataacgataatactgagctctggaaacaccgaggattcggcacatcttggttacctggtggtgatggctttcttggtgaatgtaatcaaagatattggttacttctgcgcaaggaagcccagggctttttttgggatttcgttctcctcagacagcgaagccagtcgcttttccatcgctttgatttcgtctggcgatttaccggattgagttttggcctggccctggatccacttatgaactgttgaatagccaatgccatattctctggccagttgggcagctgattcgccttgcttatataggttgataatgttttgtttgaattctttgtcgtaacgagttggcatgtaaaaattccttccttttgagagatgatttattcattataccctctcttaaaagttgtctcaggaatcagcttacatccactatttaaaacccacaatttagtttcaagtttcgtggcaaattgaaatttgaatgcataataacaagtgggggttattaattttacactggcgtaaatcgttcgacgtcgaacgatctttgggcaacatttgaattttcaatttgtggtcaagcggtggttatctggtggtcaaaacgttaaaaaacgatcaaacacagtccgcacctggaatccccgccactggagggttagctggccatttttaatggcgagtcaacagattcccttatgctctttctgtttaaattgctaatgaacttgttcatgccctgattcttcaaattggttagcattaatttttttaaatgggcatggaaagaatgttgtctcgaagcaatatttgataaatatgaggatgtcttcgcataaaaagaagttcgatgtcgagcggtttgaaaaagactccgttatctattcaggtcgaatttcccgacgtcgggaaattttaaaattaggtacatacccaattttaaaaatggacgacatcgtccgtttggaaagtcgaagttcatattaaattgccatgacatatgaccaagtgattcatttaagtaaaaaggtttcatctttcaaatggttcgacaccgaatcatttgaaagatgaaaccttatatcaaattccgacacaaatcggagttgggggtggcgaagtgtgtatgaacttgccacattgttcaaaatccgacaacgtcgtcggatttgagtgttttgacgcaatgcacttagaagtgcttattttgcgttccaagcaattttagttgttttaagcagtctccatacacaggtaaattagtaataattggttgttagaatttcactaaagggctgaaaatgctggtagtggtctctagaatagtaggcgggcagttactagaatctgtccgaggttctgcttactagtcaataaagaccccaaataacttctaagaactgcgcatctaaactgaaatcattattttgatgttaggagtaattaagctgaacgaaaagaaagtattaaaactagttgatgaaatacttgctgatccttggcaagttgatattcaaaaattgttcgaagcctctgtcaatgaacctgacgagatcaaaaagaatttgtatgattccttgtatacttatattttgcaaaaaagacaagaagctattattaatcatccaggttttgtaatctagccctttaaaagcttacttagggatttttgtgtgtcagtattatacaagcatcatattagacactgaaagcacgatgttaaacatgctaaggtactccaatatatataacagtaaaaaacggtcataaacgtttgccaatgctttatagggctattccttggtgtagtcacgtgcatgtaatctatttacgagccatgtcagttatcagtaatgtaattttttacacctgttagcgtataaagctgcttaggtttcttataagcacacaaaaaggcccatcaaattaatgacggcctctttgcatacttacagaaaatcaattcaaaatgaaagatttatggagtgttcatgttaagaacaagttgtattatatcatggttaaaacatgttgcaaccactaaaaaatgagcacccgggtaagtgctcaccaagaagttgtcacattgaaactaaatatcatgagtcccgactaataggacaactttattttagatcattctaattaaattgcaacttaaaaataagaagattccaggaagtccgatcgcttattgggctagtaaaaatcttatccacgattttgaagttggaaaacgtatggaaaatgtcgtagttcccaaagtaggactacagactggggataacaaaatatttttacgcttctggtatgaagttggaaatcagaacatctgttatagtgcaaataccatctctgaatcaactctatcagggaaaaagtggtttccgtataataaaggtggttcgtatcgaaaatggtttggtaattatgattatgtggtaaattggaaacagaatggcaaagagatacgtaattttacagataatgctggaaagttacgctcacgtcctcaaaatacggattactattttcaagagtccattacttggtctgatataactagtggagacttcagtgcaaggtatagagcaccaggaagtatttttgatgtcgttgggaaatctgcatttaaattagaaaaacaaacggacctactatctctattggggcttttaaatgcaaaagtaactaattacattttcaaaattttaaatccaacaatacacttacagactggaaactttgcaaattttccagtcattaattctaagatttctgtgtataaacaagtacaagtagctattgaaatcacccaaaatgattggaattcatttgaaaaatcatgggactttattcgccatccgcttctatcacacatcgctgacgataacctatcaatatggtattattcagtggtattgaccaatcgcggtgccaaaaatgtgccaatatttcggctttggggggtaaaataatggttagttatcaaaaacgaggcaatgtttggcaatacgaaatctcatataaagatgcagacggaaagtataaaaagctccgaaagtccggttttacaaggaaatctgacgctatcttggctgccagcaagattcaatcggaacatcctaatttgaaaaccgcgaaggcgggtagcgaatcactagtcagttactacgagcgatggattaagacttataagcagaacgcagtatcatctattacttacaacaaataccaaaacactgctaaacatgcgcgaaagttatttggtagcttaaaactaaaagagttaactaaattaacttatcaagaaaaactcaatgagtttgcaaaaacacatgcacgtcgaaccgtttcttgtttacacaagcaattgcgcgcatgtattttagaagcaatggatgaacacatcattgcttctgatcctacgcgcaaagctgttattactggccgatcactgccaaaaatgtccaaaacgctaaattacaatgattgggctaaattgattacgcacttggataccgatcaaattgatgaaatgactatctatctagctgcagtaacaggcatgcgttatggggaaatagttggtctaacaatcaatgacttggacttacaagccggtattatcaatattaataaaacttgggattataaatacaagacggggtttatgaaaacaaaaacgtcaacctccaatcgtaaggtctcaatcgataatacaaccatccatcgattaagtcactatctttcaatccaccattttgaacaagatcagcctattttaatggataagaatcatcacgttttagtcagtgctgaaatcaataacgcgctaacagcaaaactacaagtgctgtctatcccaagaattacgttccatggattgcgccatacccatgcctctatactcttataccgtggtgtcagtgttctatccgtgtccagacgtctaggtcacagcaacatcaccactactcagtctacctatttacacatcattaaagagttagagtcccaggataagaataagattatatccattctaaatgacacattaaaataattggcacttttttggcacaaaaggagctctccgacaaagagagctcctttattatgactattataatttactcaaaattttgtttccatcttgtaacttttcatagttgactaatacaccatcgtctaagtcaagattaatacgctggtcggcaacatgtcgaacaattggatcatattgcttcaattcttttaattgttgtgtgacatgttttagttttttctctaattgcttcttagttttagtgacactctcatcttgaacccattgctgtaacttctcaatacgttcttcataacgactttgtaacgggtacatatagtcagtacgcatcatggctaattcgccctcatcataacgatgtaagtacatcaatgccttcagaccattctgctttccactgttgaattcccaatagattggccgcttctgataccctttcttatgatctttaaagaaatcatccacaaaatatttacgaatagcttgctcagaattatcggcttttttaccgattacatgagcaatgtaatccatgtttgcttgaacatgctcttctccaaaagtcactgctaagaaggttctgaatcgattcatgatatcacgatcatcgtcaaagtatcggtcatcgtttaacaacaacaagttgtctttatttggcacaaatttctgatacttatcagtattccactcaccacctgcataggcaagtccaggagtgtctaacgaatatctgccgaacacaagaccaataaaatacgataacaatgatttaatatcgcgttcctcatctgcccgacgcacggaaacatctttatcttcaacttctggcgttaattcatcgttcaaaccatacaaatcaataaatattcgatttaattcttcttcatttgcctttaattgatcaaaccgctcttgtgcttcaatcttccagatagcaaaagcattttctagtcgtccaccgatctctgtttgcttatcgtcagcgatgtgagataggagcggatgaactttgaaatcccaagaatcttcaaaattattccagtcacgtctagctattgagatgctactctccacatacttgtttgtagaaaagtttattatactaggcatcaacgtgacatagccacttggtaaattgatagttggatttattaaacttaaaatataattggctactttagaattaagtatacccagcagtgcaaatcttatttttctgtcttcacataccagctcgggtgcagcagttccaaaaacaaatcccttatactctctgaatgagggacttccagaagtaacatatgaccatgaaattgcttctttaaagtaggaagcagaatctccacgtcgtactgaatttgtgacttcatccggagtatacatttttttcaaagctagtatataagaattattcccgtaccattttcgaaaactacctcccttggctaatggaacatattttggaaaagtattatcttcaggagctctttcaatttcatgataattaacttctgtccactgttttatgaattttgaatcgttaccggtaacaattcctgctttaggtgttacggactcagaaataccagaatatttctggaaagcagctacaagtctttcggacacccaataagcaatcggacttcccggaattttcttgaaacttgttctttgaaaactagataatatcaaatatattttttcataatgaaaccgagaacaccgcgttttttgagttttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtcttgtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggttcatatgaagatatttgatattgtctagttttgagagcacaagtttctcaatagtgtggtgacgatggcgagaaggatacacctgttcccatgtcgaacacagaagttaatcgccgtcttggttactgcgttacccgctgcgtccgtgtagctatacgtaacctcgtaacggcccgccttcgttggatccacgctcccgctgaccttcaaatcagctaagctcaaggctttgccatcggcatcagtcgcacttacaaagttatcggccgcactccaggttgtgttagggcccgctactaatgtgctgtctttagtgtcaattgacgtttgatcaatgttatatgttaaataaatatttgtaggctgattactttctccatagattccactaagattgctatttgcaaaaacataataataacttaccccattttttttaatgagagaagtaggtatgacattatagctactaccaatactattagctactaaagtagttggcgtgcttaactccgtaccatttttatcaacataatgaacagtaatgtctgaatatatagttgcattaacagattgagttactgtatttccatcactgtcagtaactgtatatataatggtgtaaactccatttttattattattccaagcgttaacaaaattggtatcatcttttatagtgacagtggaacttagatttccatcctcaacatcagatgctgttacgccatccagcaaccattcagtaatatcagaaacagtggtgccttgcttaatatctttatctgtcgctgttattttaggcacaaagccactgttattaatattttgaaaatatcctgaagtccaactttcttgtgcggttgttatataatcagactcatatttatccgtcaaaacatactgactattaaggtttggggtagtagcaactatacctaaaacataccagccaatatccatattatcaggtatcgatatttttacagtttgatcatctacttgagttgttgtccaacctacagatgataatgttacatagcttttggaagtattaggatacccgcccttttctgttatataaatattgtcagcctgtagggaagcccctgtgccagaaatacttaaagttattgttcgacctgttttatcgttttgagaattagtataaaagcctggatcaactacaacattaaagtccatagactgcatatcgggcaaatagtagttttttccactaatatatcctacataattatcctgtataccagtatatccataatctccatttcctataattaatctttgaccattatagctcccgcttccaccagaactagcttttgtattgaagctggtaccaccagttattgctactgaagtattatttaaagatgccgtaatgatattgttagaagtatcggcggcagccgtatgcaaattaactatgaagttaattcccgcattagaaatatcagtattgaacgtatatgttattgtcccactggttttatcataagctaagctgccataagttgtaccaccatttaactgaatattgtcccaattaatcgagctaggattagatactgtaaaagttaactttgccccattagatatggttgcactcttctcaatactcgtatttagcgctataacgcctcccccaccagagaaagtgtccccattattaaagcttgaagtaacagtcactcctgtagtatctgtttgacttgacgagttgtccattgctaatttggcattgctaatccccactttggctgcactactggttgtatcagcattcactgcgctgctactgctggcactagtcgcatcggccttcgttgcgttgctacttgcgctggtcacatcggccttcgttgcgttgctacttgcgctggtcacatcggccttcactgcactgctactacttgcactggttgcatcggcatttactgcactgctacttgcgctggtcacatcggccttcgttgcgttgctacttgcgctggtcacatcggccttcactgcactgctactacttgcactggttgcatcggcatttactgcactgctactgctggcactagtcgcatcggccttcactgcactgctactacttgcactggttgcatcggcatttactgcactgctactgctggcactagtcgcatcggccttcgttgcgttgctacttgcgctggtcacatcggccttcactgcactactgctacttgcactggttgcatcagcctttactgcactgctactgctggcactggtcgtatcggccttcactgcactacttgaggtactggtggctgccacatcggctgacactggccgactggtaactagcatacctaatcccagcgaaaataatgaaatccccataacagcccaatttttaccgcatttatataatttataatgcgttttagtctctccaaagtaattattctttaacataaaaaaaactacctttcacactaaggtttccgtaatattccttagaaaggaggtgatccagccgcaggttctcctacggctaccttgttacgacttcaccctaatcatctgtcccaccttaggcggctggttcctaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttaccccaccatctagctaatacgccgcgggaccatccaaaagtgatagccgaagccatctttcaaactcggaccatgcggtccaagttgttatgcggtattagcatctgtttccaggtgttatcccccgcttctgggcaggtttcccacgtgttactcaccagttcgccactcactcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgttttgctcttgattcaaaattagggccgaacgcccggttttaccgcgaacggtatcactttcccaatgaccaaaccagcttcgattctcacatgaaacaggtcgttcatgaacggaagggacgtcgttaaatcgtccccgacgttccttaatggttcccttgacctttcgggttttaccacggtgacggagcttacgggcaaagccacgagcctcgtgattcttacgtttgatgcctaaattatcacgttcaatcccacgataaatggtgttataactgacatgccattcactgttttcgtggactaaacgaccggaaatttgttccggggaccactgacgttgaacaatacagtgaagaacaaaatcccgtaacttcaaatcagttagaagcctaggacgtcggctttttagccgccgtccctgatagttctcttgggctttgacggccgagtatgccttacgaccaccattgcgcttgatttcgcgcgatacggtggctttggaacacccaattttctccgcaataacttgataggtatcgtttaaagtgacgcccaacagtatgcattctcggtcttttaaggtaagatggttgtacggactcatagcctaggatctcctttagatgattgttgtggtgacttcattttataggactcaggctatgagttcttttttatttttttcttacttgttgcacttcaattgtaaattcgtcaccatagaccgtagcttttttataattactgttgcagaagttatagttcttaagctaggggaagccagtagccctttccattctatttttcgttgagagagccccttgcacacaaacttttataaaatatcaacaattttttcgtcattctcgaaagtgatacttttaacttccttataggtattcatacgaagtttaacagttttagtctttttcgtttcaatttggtatggttttttagattatcaagttgttcagacgcttttttgctaactttatttagaaaattttctttcatagtagataactcttctaattgttgaattctaagtaactgttcgttaaggaccatttggtacatttgaattgcacttttagcccagcgatttttattacgtacttcctcattaataaaggtctttatccgctcttgactggggtgctcctcatggaacgtctggtagtttactggttttgaaattagattaataaaatccgttttaaaaccatcaacacccttatctagccagaagcgttcaatatcaaaaactgcttgtcgaacttcggaatttttcaagttgagatcaggctgaccaggtgcaaataaatgtagataatactttttccacgaggaaacataggtccaagcaggaccatcaagggcagcctgctaattattaggctcatggccatctaccggattatgccaaatctaaatattcttattccttgttaatacattttaattttcttaaaggagcaaattttttgacgtcttgaatatataatgagtaaagtgtttagatagagtaaaaacaggccataacttaacagttgtggcctcttttttgatgctctataattaaggggttagaaccgtgtcattacttaatgacataagtgaggagataaaaagatgaaatacataaaccaccgtgaagtcaagatcactagaattaatgtagacagtctgaactgcaacactcttcaaatcagagtttggagcatcattactagttattgtatagcccttaactactggattggcaacttctgaaaaatctgcactagttgctttcgtccacccagtagcagttggtgcaccagtttctttgtctaagctaacatctgtagttatatttgaataataaacaactgctgacccatcaactgggttagtaaccgtcaagaaagtaatttgctccgcaatgtgacttgccgccacagcccttccatcttggtcaacataatgaatagtttcattaactgttttactggtagctgtatatgcaggagcatatacataaataacagttccattgtcgccgggcttagttaaagaacccgtggattccagcgacccatcactcatttttataaaagtataattaggtatatcgagctgtgttgtcacataggtcccgttaacattagtaccatctggataagaaactattccttgagctatttgattaccctggatgtcaacatatttaacattgacagttgctgcctgttgaaagttaaaatcatcaattttaaattgttgcaaatttttagctccaccagttgaagcactgataatcatcgacattgcttgataagaactatcaacagtagttatccaggtcaacacttttccactggcctgcatataactaactgtcaatgttcttgtagtaccatcataattaacctcaaagttatggaatttaccatcaatatcagccttacttaatgcctgtggattgccggtatcctgcgcccaccaacgctgcaccatggaaccatcctgagtcttaacttcttgattactagttttaacaaatgtaccgtaaggtgcattcatagaatccttattccaaccgaaaccattagaatccgttggcaatatttcgctgccatccttgtctgatgaaggtgcctgataaccattgttccacgtatctaatttaaagccaatggcatcctgtagtccaccgattcctaaattgcccccagcatttcccatatcagtcgtattcccactgtgaaaggcaaagccaattccgtctgcaccattaggatcagaccctaattttacctgaccagttaatgtaaagctcttattcatatcaattttactgttcaatgaaaaattaccgacttgattatttctattgggtgttatagttacaactccagaatttttatcataactagcggaaccgttcaaactgaaatagtcaagaaagttgtccttggtcacgtgtgtcagagtatcttcactagccgccaaggtcttacttgtacgtaattgttgcaataatgtattgtaagaaatcttagttacattttggcgtgttttaacactagttatattagccttcgctgcactgctactacttgcactagtcgtttcagccttcactgcattgctactacttacactagtcgtttcagccttcactgcactactactgcttgcactggtcgcgtcggccttcactgcactactactgcttgcactggtcgcgtcggccttcaggacaaaccccaacagcggcctgcgcttgctgtttttgttctacctgttgttgggccaccaattgcgtctgtaagtccgcattctgggcaaactgctcgggaacttctttaagcaatttttggattaacaacttaatctggcctaaaaagttttcgggcgtgcgctttttcttaccaatttcttttaaagctagttcccatttcgctgtcattgacggactcgttaacagtggttctaatgccaccgcttggcacagtgtcacaccagtgccactaacatgtaactcatttttattcgtaactaaatagtgccgccgtttcagcgtttctaacacattggcacgcgtcgcttcggtgccaattccctcgacatcttttaacaccgccgcttcgtctgcgtccaaagtcttgccggctgttttcatggctgtaattaaggtcccttcggtaaacggcttcggtggggtggtctgtttcgtcggagtggttaagacagcttgtaccgtttgaccaggcgtgaccacgggtagtgtgtctttcccctgctcaactgattttgtcttgaataggcgtcgccaaccaggattgattgggactttgcccactgatttaaacagtgcctgtccgacctgcgttataatggtcgtttctgtatactcataaggccccgcaaacatggctaacgtggtttttaacaccaagtcatagacctggcgttgtaagacgggtaatttagccaattgagttgaactaggcaccactttcgtcataataatcgcggggtgttccgtcactttctgatcattgacatagcgcttttgcggcgtggtctgtggtaaagccattttttcaggcaataactcttggtactgatccaggttcgccgccaaatagtcaaactcttgcttcgtaaggtactcactatcagtgcgcggataagttaaccacttagcttcatataaggcctgcaccgccgctagggtttcactcgcactcgcatgaaaccgttggttaaccgcactttgtagactagatagtgaaaacagccgtggactaggggtctttttgacgatgttttggacatctttaattaaagctgtctgtgggccccgctgaacgtttttatcctgcatgaatatcgttaatcctttttcgtctttaaagcgctgataggggtctaattttgcctcgaatttttgctgattggctaaaatttcagcatttagctccaagtagggctccggtttaaagtttttgatcagttgatctctttgatagaccatatatagcgctggcgtttgaacgcggccaatggcgtacacccccgacaacccatgttgccgtaataacaaggtgtacagcggactagcattcatgccaacgagccaatcactgatctgtctggtctgggcttcttggtaattcggataaaattgccacccatctttcaaatcgcgaaagcccgcgataatggcttctttttccaaactgttgatccacaaccgttgcatcgttttgtgttcgacatcaatttgagcttgtttcatgatcgaccaagcgatattttcaccctcacgaccattatcaccagccacaatttggtaacgctggttggagtgccgcgaatttttctgcggataaccgggtcgttaaaatcggcaacgtctgttgggacaaggcttgcacgatacccacaatttgggttgccgtcttaccagcaccgtagatgacctccggaaagccattgcggcgttgacgatctaaatcgacattggcaaaacctaatgccgctgttttgcccgcttctaactgttgggcagccaccgtcggacttaattgccctgccgccacttgttgtaatatttctgctgtggttgccatactacttcacaataacgcctaaaccatcaggaataaccgtcactttagcggcttgaccctcgcgtgcgtaggccttttccatggcttcatctaacgtcttggctagttccatatgcatattcgtaatcaaatcaggatcaacgaggtctgacacaaaaatcacgtgatgatgaactaagattcgagcaaagatttgggccgtccattggtcaggaatagttttaagccgtggcgtgttgattgcttggtccaggaattccttaggatcatcaacgtcagctaagttgtgataaaacccttcaccaccgtgaccatcacgagcaccggcaaccataataatcgtgccgccttctttgtttgttgcttcagcagcggtcattcctttaacggcttgataaatattttgatcaagcggataaccaccattcgtcgaaatcgcaatgtcacaatcaatggctggtacactagaaagttctttgacaaagtcacagcccactttatgggcggcttccatgtcaccggcaaatgacccaatgatttttttatcttcgtctaaaacaacattgataataaaggcaagtttagcggtccgagcagcgtacaccatatccttatgaatcggattatgcattaaattaccggtccgggccttcggtgagttaataaattcgccggaatggttcgccataatcgtcttgtatgaagcaatcccaggtaaaacggacttccgaccacctgaaaaaccagcaaagaaatgtgattcgataaagccttcggagattagcaaatccgcttcagcagcgaccttattaataatgcaatcgccgccagatggtaattggccaatcttgaccatactactgtcatcggttgagacatgcatcacgatttcttcgttattgacgatgtcttcaccatacttattcaccaattcttcgtgggttgatggccgatggaaaccagtagctacgaggatccgaatccgtgcatcgggcgccactgaccgtaaccgccgcaataggatcggggtgataatatgtgaaggaactgggcgcgtgtgatcggaactaataatcacaatattgtgcttcccacgagcaagttcctccagcttatcggagccgattggattatccagcgacttctcgaccgtttcctgttctgataatttgttatgatatgttgcagcttgcgacactaacttaccggcgtaattttcatcatcaatctgagccgtaattgtgcgcttgtcatatggtaaatcaatttctatgatatttggtgttgatggataaaatccatcaacactatttttatgcacaacaaaagggcctatcgtcctgtgctacaatcaagttgaccaaaaccaattgaaagcgagtatcagatatgtcccaagaccattccactaacgtactgttccaaattaaaggcccgaatattactgatttagttgctcaagaagctactaacggaagcttacaagtgcttgcgaagctaacgtatccggttactgtttgcgcacgttgtggcaaacgttccatggttaagaactgctttaagaccgttcatatcagaattcctagaattagcgcacgggccaccatccttaacttaaagaagcagcgatttatttgcaaaaattgtgataaaagtagtttaacaacgactacgctggttaaaaaacatcatcaaatatctgaaaacagtctgcatgccattgatctatcattaactgaagaccgtacaatggcgagtattgcgactcaatacaatgtctcgattaatacgatgagtcgccgaataaagttactcggacaaggtccccaaccagctttcaacggattaccaatgatgctttgtatcgacgaatttcgttcaactggtaaacaaatgggttttattgcggtggctgcccaaacccacgacatcattacaattttaccaggacttaagaatgccgatattaaagacttatttctcaatcattattctaaacggcatcgtgaccgcgtgactcggattgtgatggaccttaattctcaataccaactcgttattcgaacactctttccacacgccaaactggtcgtgaataccaagtgcttaaatattattggcggttatatttaaaagattatgacagcgtttgaaaagcgcaaaaaccaatggtttgcgcatcttaaagatcgcatggcacaagagcaattggtcgtaaccgttttaaatctagaccaacagtttcgacaaacctaccaagccgtacatgccttagttaaggcttttcaaaagcgtgattatcgatccttcaaagcagccctaggtaatgtcgaaaatgtcagtcctcagctaatgaccaatattaaaagctttatcaagaaccggcaactcatcaaaaatatgactaccggccgattatcaaatggtcccgtagaaggtgtgaaccgtaaaatcaagcaaatcaaaagaaccgcatatggttacaagaactggcaaaactttatttatcgaattcaaattgaattcaaaatcaaaatcgaaaaaagcttcctggtttctcagtttaatgtttataacgagaagtctctgaagcggatccaccgagggttccaaggactccaggacaccttggaagcatcatttatttaagttagatacatattatatgtacgaaggcatttcatttacacaagattcttgacgctacccatcaaattgcaatataaaaaagcacccactaaacaagtcgccgtttcaccctacaaatatcattataatagcattaaaattagtacagtaaaaggcctatccaattaagaataggccttttactgtacttttagagagtcaattgtgtcaactcagattaactatgccacaaagacaaatatactacaacattaaaatgaaaggagtgtccacatcaagaacacacgagaattatatcacgataacgatccatttcaaccacctaatcaaaataaaaagggcttatccatgatagacaggccttagttgtattcacgagaaagtataatcagtatacttgaacacaattttattatcaaaaattaagctggtctaattagactacttatgattttctgttctttaatttttattaaaattggtaatagttttttgtccatattcgggcaaaaattcacttcatgtctagattatctattgtcgcatatttatatataatggtttatacaccacttactaacatcaattaaccttcttctatgaattcgaatctttacatcctttttaacttttaaattaacaaaaccattcttaactaggataatgttacatcggcattttgtataggggggaaaacttagaccataccagtcgtttatatctgatatacgatttattgatcattaatgagtggttcattaatccggcgtccgtaaggcgcttttttaattgagatcaaagcttagcttaccagctactaacttcaacttggcactaaatgcttccccgttttcttactcttaacccccttgagctgggctgtctcaccagtcttgatcagttgtttaatggcacttattggcaatttcttgccactccattgtttggcaacgagaaatgacaccctgctgatagttggaacacccataaaacttgccacaatctgaaatctcacccgttttacataccaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcaggttttaattgaccgttttgcatcggatcttccttgacccgcataaaggtggcatcgtgatccgtcttagagtagctgttacgttgatcataaatagcttgctgtgcttggtgttcacgcattttatcacgtcgtttatccaacttacgtttttgtgatttaacagtccggcgttgctgtttggctgggttcggggaaacctgcttagttgcttccacggtttcattaaggaccactaagtgatcctcaaccttgctaatcatgatatccaatagttcgggagtcagctctgatcctgccggaatttcaccgacaattttagcttcatgaagctcgcctaacaggtcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgagttagttgtgataagctatcggttgtcaaagtggccagttcatcagaaattctaaagcgacaaatcgtccggtaggacggaatttggtcggcaattaaccacccagctggcttgttttcacgggcaaaccgttcaattttacgactgctgaaaatgccatagctgtacgctaaaaggaccagttttaacatggcaccgaggttatattcccgcggacggccaaactggtaatcatattttagttttaaactctcaacaagctggttgatgtaacgagcagaatgatgctcttctggttggtaatccaaggcacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactggaatctggactgaactgctggcaaccttgatcaagcagggcgttaaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaacctgattgagaactttaataagcatctcaagcgcaccacccaccacaaagaacaatttccaacggaagattcactggatcaatcgtatcggcccgatttaataacgtcttaaccacctgaaactgcttttgtttgtccgcaataacttcgaattgataggtggttggaaatattggtaaattggctaaagcccaattgcgatacttcgcatcatatttttctggcgggacgagttcgaccaaatggcccagcgcgtgtgtcaccagcgtatcattgggtaacactggatcactaacctcatagtaacccgactttttctgactcttttggaaggccgccacatatgctcgggcctggctgggtttttctgctaaaattaccgttgtcataatttgcactcctaacattaatttagtcccagcttaccagcttggcggccgtagcattaaactcaccctccagaaatacttgttatgagtaacgatgcttgcattacggctcgcactgtactaaagtaacaatcgtattatattacttctccaagtaatcctttttgtacaaagattagtcctatgtactatattttctactccgaccactcataacccccattatgagtggctttttggtcttagaacgaccttttagccactgaaatgtttcttgcaagtaaccggttgtatattgattgctaaattttccaatatacgttattttaagggtgccaaagcttctcctgttttggcattgcggtatataacctaatcaattttttcacacagtttccgctgaccgttcgcaatcctcattacgagcgtttttttaatttttgtggtaaaataatcctagaaaaaggaagccttgcttgtacagggcttcccgtgtagagccgtttaagacggtgacaaattttagactagataggggtctatgatatttagtgttgatggataaaatccatcaacactatttttatgtacaacaaaaggacatatcgtcctgtgctacaatcaagtcgaccaaaaccaattgaaagcgagtgtcagatatgtcccaagaccattctactaaagtactgctccaaattaaagacccaaatattactgatttagttgttcaagaagctactaacggaagcttacaagtgcttgcgaagctaacgtatccggttactgtttgcgcacgttgtggcaaacgttccatggttaagaatggctttaagaccgttcatatcagaattcctagaattagcgaacgggtcaccatccttaacttaaagaagcagcgatttatctgtaaaaattgtggtaaaagtagtttaacaacgactacgctggttaaaaaacatcatcaaatatctgaaaacagtctgcatgccattgatctatcattaactgaagaccgtacgatggctagtattgcggctcaatacaatgtctcgaccaatacgattagtcgccgaataaagttactcggacaaggtacccaaccagctttcaacggactaccaacgatgctttgtatcgacgaatttcgttcaactggtaaacaaatgagttttattgcggtggatgcccaaacccacgacatcattacaattttaccaggacgtaagaatgccgatattaaagacttctttctcaatcattattctaaacgtcatcgtgaccgcgtaacccgggttgtgatggactttaattctcaatatcaacccgcgattcgaacactctttccacacgccaaactagtcgcaacgtgccacattcccatcgctaattaagcgaccttaataaacaacatttataataacatacttaaactttaaattgaattacatacaagtaaatattgcaaaactagttcagcaattgtacataggccttcactatttagctattaatgtttaaattttcaatttaaaacaacaaataagaatcaaacgacgaccctcagtctcgtcttttatattgtcagcgcatagatataaagttcgacataatctacttcataagttatgccaccatataataaaaaaatgtacttcaacgaggtaatctaccaccgaatttgactgcaacgttattgactgaaaagtaacactattccgaaataaagatctataagtgattttttgactttttttattttcctgagcttcatgagtaacatgtcaaaaaaataacatggataatggcacatgacaaacagtggtatagtatctgtttgcatggctgagttgactgcaacggagggttatgtgcagtactggctaccaagtgttccttcttagattattgaattagttttttaggaattctggtgagtgtcaatttaattgcagcacgattatttggggaagctgagttctggtttgccatgattttaactggtgttttcatgctcataaaccattccgtttttactaaaggctgattaaatcaaattatgggtctctgtcaactggcgtcgatgaagttatatttagaatccaattcatttacgaattgggttctcggctgtctatcatgccactgcgcagtgtatgacggtcggagaacaaccagcaccgaaaacaccagggtacattgccgtggtaacggcggggacctccgatcaaccggtcgctgaagaagcagcggtaaccgcagaaacttttggcaatcgcgttgaacgggtctatgacgtgggtgtcgcggggatccaccgactgtttgccaagttggatgtgattcgtggtgcccgagtagtcattgtgatcgcgggcatggaaggtgcgctggccagtgtcgttggtggcctagttgataagcccgtgattgcagtgccgactagcgttggctatggcactagttttcaaggcatgactgcgttattgaccatgctcaatagctgtgcgtcggggattaccgttgtcaatattgataatggctttggtgccgcctactcagctagtatgatcaatcaaatgtgatattcagttaactgaacaaggagaaaacaaatgcaaacactttatttagacgctttttcagggattagcggtgatatgtttctgggcgcgttactcgatttaggacttgattttgagcaattaaaaaccgaattggctaagttacacgtgcatggttatgaattgacacagcaacgagaagctatggctgtctatcatgccactgcgcagtgtatgacggtcggggaacaacccgcaccgaaaacaccagggtacattgctgtggtgacggcggggacctccgatcaaccggttgctgaagaagcagcagtaaccgcggaaacttttggcaatcgtgttgaacgagtctatgacgtgggtgttgcgggaatccaccgactgtttgccaagttggatgtgattcgtggtgcccgggtggtcattgtgattgcgggcatggaaggtgcgctggccagtgtcgttggtggactagttgataagcccgtgattgcagtgccgaccagcgttggttatggtactagttttcaaggtatgaccgcgctattgaccatgctcaatagctgtgcgtcggggattaccgttgtcaacattgataacggctttggtgccgcctactcagctagtatgatcaatcaaatgtaagattcagttaactgaacaaggagaagataaatgcaaacactttatttagacgctttttcggggattagcggtgatatgtttctgggcgcgttactcgatttaggacttgattttgagcaattaaaaaccgaattggctaagttacacgtgcacggttatgaattaacgcagcaacgggaagccctaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtgattactaaatatcataaggaaaggcattccctatttctatacaattcagaaatcttttatgcatttacacaagatattttacgctctcatttgatgagattgagttaaaatgaaagttgtcctattagtcgggactcatggtatttcgtttcgaagtgacaacttctttggtgagcacttagtcgggtgctcacttttttattggttgcaactatctttcataatgctataattaactagtgtgttatggcattgacacgctactttcaattacttttccgtaagtaaccataaaaaggcttattcttaaatggataggcctttttactgtctttctgagtgtctttagttaaaaggggcctctgtcaactagtgttgatggagttatatttagaatccaattcatttacgaattgggttctcaacatcgatcttacgttgagcgtagatctgaccagtttctggagctgaaagtaattctcgttgtttcgatttgaaatattcccaattttcgttcacggaaatccttttaagatatccttttggtgttagtgccgcggaaattagttgatgattttcatcatacttttcggcaatgtattctttaaagtcacgggtaaaaccatacttatcagtccgttgacgataagcattaaaattaaaccggacgttttgtggattgataaaataatcatctttttcatgatagtcccagttcataaccttacggtcatcactttgccattttcgactattctctttaagcattgtgccgtatggaattaaaacggtatgctgaccgaattcatcttccaagtaccgataattactttcggaaccgtatccggcatcggcaccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcgacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgaccgctagcttgccagagctaaggcggctattttttttgctgacttttaatcagctcaacaattaatgcgattaaggctacgataaacgtaccgaaagccagcattaattgtaaagcgtccgacacggacacttgggctactcctttcctggaattttggttggcttattaggtttacaccataagcaccacctccaatactggaaatagccaccgccttaacttctctactagcatagtataacataatgcacgctgtaactaccgatactacggtattcacagcgtgctttttagctaatttatccattgcaagcaagcattgacactaaagacagcacgttagtagtgggccctaacacaacctggagtgcggccgataactttgtgagtgcgactgataccgatggcaaagccttgagcttagctgatttgaaggtcagcgggagcgtggatccaacgaaggcgggccgttacgaggttacgtatagctacacggacgcagcgggtaacgcagtaaccaagacagctaccatcacggtagtggcgtcgcaagcaagtattgacactaaagacagcacgttagtagcgggccctaacacaacctggagtgcataaaccaccgtgaagtcaagatcactagcgtcaccactcacagtttgtaccccaatttcagcttgatctggcgtgtaacccttaatagctgggctagtcactgccgcaaagctttgatcagctgaccaagacccataggtcttttcacctgtaaccgcatcagttgagacttgacgtgtaaattcaaccggcgtggccacataatcatcgtgagccgtcgtaccatctttgtagacgtaatggatagtttcattaaccgtcttgttttcggttgtaacagttggcgcatccttggtcaatgacgactaacgtcgtcaatggagaatagcgggatcgaaccgctgaccccctgcttgcaaagcaggtgctctcccagctgagctaattccccatgaggtattcaacttatggaaccaactggttcggttccaatgggcctaaatggacttgaaccatcgacctcacgcttatcaggcgtgcgctctaaaccagctgagctataggcccaaaaaacgcttattaaattgagagttagacctctcaaaactaaacaaagtttcgaagaatgtgtagtgtgaaaggtaggttttttatgttaaggaatagttactttggagagactaaaacgcattataagttatataaatgcggtaaaaaatgggctgtcatgggaatttcattgttttcactgggattagggatgctagttaccagccgaccggtgtcagctgatgtgacagccaccagtgtctcaagtagtgcagtgaatgtcgatgcaaccagtgcaagtagtagcagttcagtgaaggccgacgcgaccagtgcaagtagtagcagttcagttatttaacctagtaaaagccaccgtcttaaacggctctatatcgggaagccctgtactagcaggacttcctttttctatgcctatattatagcacggttggattaggttttgaagcaatgggaacgcgagcgatggttgcttagggctgggctagactagggtgttatttagattctagccgtcccgtagaccacaaataaagtcagatagacattgtgaacgagcaattaaaaggctatgcgcgggtcagtaccactgatcaaaaattagcaaatcaaattgagttactaaaattggcaggagcagaaaaaatctttcaagaaaagtttaccggcacaactactgaacgaccggagtttcaaaaactgttgcgcgttctaaaaacaggcgatactttgattgtcactaagttggatcggtttgcacggaatacgcgcgaggcattagccattatccaagagttgcttcttagcgccgagagtagttgggggatcgctccctgcgagggtaggacgttgccatgcgaaattggaggattagctcagttgggagagcgtctgccttacaagcagagggtcacaggttcgagccctgtatcctccatcatgagccgttagctcagttggtagagcatctgacttttaatcagagggtcgacagttcgagactgtcacggctcattagagtagcatctatggcacgagctttgatgttcaggttgcgggtggtaaggaccatggttttgtggaacatcaccatcatcagcatgaagctgggcatcatcatgatcatgaagcgcgtcatttagctgatattgaggcgttaattgacggcagtgacttatcagataccgtgaaacaccacgcgaaagcgatttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatcgcttcttagcgccgagagtagttgggggatcgctccctgcgagggtaggacgttgccatgcgattattccgacatagctcagttggtagagcgcttgactgttaatcaagatgtcgacggttcgagcccgcctgtcggagttggtccctaccgtgaccagtttcataatgtttaacgccagtattacgattccggcttccttggtgaccttgtcgaaacctcgcaccgagaatcgattgaaatgtaaagaagccttcatcttgccaaaaactggaccgatggcaaagccttgagcttagctgatttgaaggtcagcgggagtgtggatccaacgaaggcgggccgttacgaggttacgtatagctacacggacgcggcgggtaacgtcgttaccaagacggcgatgccactaccgtgattgtcgccgtcttggttactgcgttacccgctgcgtccatgtagctatacgtaacctcgtaacggcctgctttggttggatcgacactcccactgaccttcagaattgttttgacttaatctgttaaaattaatattgaaaaaagctttatttgcgcattttttggtgtagttaatgaaaatattatgtatttagtgagatgttatgttataatcgattctttcgtgcgaaagataggcccaatttaagggatatcagaggatattagtagtttctattctaattgaaaaggcccgatagccttaataaaccgggattttaatgacaacatttaaatgttgtcataaaaagcccggtttattaaggctatcgggccttttcaattagaatagaaactactaatatcctctaatatcccctaaattgggcctatctttcgcacgaaagatcagtcgcactcacaaagttatcggccgcactccaggttgtgtcggggcccgctaccaacgtactgtctttagtgtcaatacttgcttgcgacgccactaccgtgattgtctaaccgcaaggttaaatggatattattcaatttaatatttagtttcacatagtgtggtgatgatggcgagaaggatacacctgttcccatgtcgaacacagaagttaattgcgagtgaaacgttgacttaattgaggtcgtcaaggatacggttatcgagcggcaatgacgaatcgtatcaaaaatattgatttaacaggaatcaattcgcac
